(12) United States Patent
Thompson et al.

(10) Patent No.: US 7,960,534 B2
(45) Date of Patent: Jun. 14, 2011

(54) THERMOPHILIC AND THERMOACIDOPHILIC SUGAR TRANSPORTER GENES AND ENZYMES FROM ALICYCLOBACILLUS ACIDOCALDARIUS AND RELATED ORGANISMS, METHODS

(75) Inventors: David N. Thompson, Idaho Falls, ID (US); William A. Apel, Jackson, WY (US); Vicki S. Thompson, Idaho Falls, ID (US); David W. Reed, Idaho Falls, ID (US); Jeffrey A. Lacey, Idaho Falls, ID (US)

(73) Assignee: Battelle Energy Alliance, LLC, Idaho Falls, ID (US)

( * ) Notice: Subject to any disclaimer, the term of this patent is extended or adjusted under 35 U.S.C. 154(b) by 276 days.

(21) Appl. No.: 12/380,554

(22) Filed: Feb. 26, 2009

(65) Prior Publication Data
US 2009/0253205 A1 Oct. 8, 2009

Related U.S. Application Data

(60) Provisional application No. 61/031,593, filed on Feb. 26, 2008.

(51) Int. Cl.
*C07H 21/04* (2006.01)
*C12N 15/63* (2006.01)
*C12P 21/00* (2006.01)

(52) U.S. Cl. .................. 536/23.7; 435/320.1; 435/70.1; 435/71.1

(58) Field of Classification Search .................. None
See application file for complete search history.

(56) References Cited

U.S. PATENT DOCUMENTS

| 4,581,333 | A | 4/1986 | Kourilsky et al. |
| 5,098,825 | A | 3/1992 | Tchen et al. |
| 5,882,905 | A | 3/1999 | Saha et al. |
| 5,916,795 | A | 6/1999 | Fukunaga et al. |
| 5,948,667 | A | 9/1999 | Cheng et al. |
| 6,083,733 | A | 7/2000 | Gronberg et al. |
| 6,268,197 | B1 | 7/2001 | Schulein et al. |
| 6,426,211 | B1 | 7/2002 | De Buyl et al. |
| 6,506,585 | B2 | 1/2003 | Danielsen et al. |
| 6,777,212 | B2 | 8/2004 | Asakura et al. |
| 6,833,259 | B2 | 12/2004 | Bhosle et al. |
| 2003/0134395 | A1 | 7/2003 | Shetty |
| 2003/0233675 | A1 | 12/2003 | Cao et al. |
| 2004/0029129 | A1 | 2/2004 | Wang et al. |
| 2005/0112742 | A1 | 5/2005 | Thompson et al. |
| 2006/0211083 | A1 | 9/2006 | Katzen et al. |
| 2007/0082381 | A1 | 4/2007 | Wilting et al. |
| 2007/0134778 | A1 | 6/2007 | Benning et al. |
| 2009/0263859 | A1 | 10/2009 | Thompson et al. |

FOREIGN PATENT DOCUMENTS

| WO | 81/00577 | 3/1981 |
| WO | 03/068926 A2 | 8/2003 |
| WO | 2005/066339 A2 | 7/2005 |

OTHER PUBLICATIONS

Kohler, G. et al., 1975, Nature, 256(5517): 495497.
Kwoh, D. Y. et al., 1989, PNAS. USA, 86: 1173-1177.
Lavarack et al., "The acid hydrolysis of sugarcane begasse hemicellulose to produce xylose, arabinose, glucose and other products," Biomass and Bioenergy 23 (2002) 367-380.
Liu C, and CE Wyman, 2003, The effect of flow rate of compressed hot water on xylan, lignin, and total mass removal from corn stover, Ind. Eng. Chem. Res., 42:5409-5416.
Luckow, V. A., 1993, Baculovirus systems for the expression of human gene products. Curr. Op. Biotechnology 4: 564-572.
Lynd et al., 2002, Micro. and Mol. Biol. Rev., vol. 66, No. 3, p. 506-577.
Malherbe and Cloete, 2002, Re/View in Environmental Science and Bio/Technology, 1: 105-114.
Matthews, J. A. et al., 1988, Anal. Biochem., 169: 1-25.
Merrifield, R. D., 1966, J. Am. Chem. Soc., 88(21): 5051-5052.
Miele, E. A. et al., 1983, J. Mol. Biol., 171: 281-295.
Mielenz, 2001, Curr. Op. in Micro., 4:324-329.
Lucas et al., C4-Dicarboxylate Transporter/Malic Acid Transport Protein [Alicyclobacillus acidocaldarius LAA1], GenBank Direct Submission, Accession No. EED06059, Dec. 17, 2008 (Retrieved from the Internet Dec. 15, 2009: <URL:http://www.ncbl.nlm.nlh.gov/protein/218238848), p. 2.
PCT International Search Report and Written Opinion of the International Searching Authority for PCT/US09/34701, dated Jan. 27, 2010, 10 pages.
T. Collins et al,, "Xylanases, Xylanase Families and Extremophilic Xylanses," FEMS Microbiology Review, 2005, pp. 3-23.
K. Eckert et al., "A Thermoacidophilic Endoglucanase (CelB), etc.," Eur. J. Biochem. 270, 2003, pp. 3593-3602.
Ito et al., "Purification and properties of acid stable xylanases from *Aspergillus kawachii*," Bioscience Biotechnology and Biochemistry 56 (4):547-550, Apr. 1992.
International Preliminary Report on Patentability and Written Opinion of the International Searching Authority for PCT/US06/42566 dated Apr. 23, 2009 (7 pages).
Supplemental European Search Report for EP 06 82 7231, dated Nov. 12, 2009, 6 pages.
Shallom et al., "Microbial hemicellulases," Current Opinion in Microbiology, Current Biology Ltd, GB, vol. 6, No. 3, Jun. 1, 2003, pp. 219-228.
Eckert et al., "Gene cloning, sequencing, and characterization of a family 9 endoglucanase (CelA) with an unusual pattern of activity from the theremoacidophile Alicyclobacillus acidocaldarius ATCC27009," Applied Microbiology and Biotechnology, vol. 60, No. 4, Dec. 2002, pp. 428-436.
Neddleman and Wunsch, J. Mol. Biol. 48: 443 (1970).

(Continued)

*Primary Examiner* — Suzanne M Noakes
*Assistant Examiner* — Jae W Lee
(74) *Attorney, Agent, or Firm* — TraskBritt

(57) ABSTRACT

Isolated and/or purified polypeptides and nucleic acid sequences encoding polypeptides from *Alicyclobacillus acidocaldarius* are provided. Further provided are methods for transporting sugars across cell membranes using isolated and/or purified polypeptides and nucleic acid sequences from *Alicyclobacillus acidocaldarius*.

12 Claims, 63 Drawing Sheets

OTHER PUBLICATIONS

Olins, P. O., and Lee, S. C., 1993, Recent advances in heterologous gene expression in *E. coli.* Curr. Op. Biotechnology 4: 520-525.
Pearson and Lipman, Proc. Natl. Acad. Sci. (U.S.A.) 85: 2444 (1988).
Sanchez-Pescador, R., 1988, J. Clin. Microbiol., 26(10): 1934-1938.
Schäffer, C. et al., 2001, Prokaryotic glycosylation. Proteomics, 1: 248-261.
Schwermann, B. et al., 1994, Purification, properties and structural aspects of a thermoacidophilic alpha-amylase from Alicyclobacillus acidocaldarius ATCC 27009, insight into acidostability of proteins. Eur. J. Biochem. 226: 981-991.
Tsao, GT, MR Ladisch, and HR Bungay, 1987. Biomass Refining, In Advanced Biochemical Engineering, Wiley Interscience, N.Y., 79-101.
Urdea, M. S., 1988, Nucleic Acids Research, II: 4937-4957.
Upreti et al., 2003, Bacterial glycoproteins: Functions, biosynthesis and applications. Proteomics, 3: 363-379.
Vieille and Zeikus, 2001, Micro. and Mol. Biol. Rev., vol. 65, No. 1, p. 1-43.
Eckert, Kelvin, "Dissertation, Cloning and Characterization of two glycosidases from the acidothermophile Alicyclobacillus acidocaldarius ATCC27009," Berlin, Dec. 18, 1971, 113 pages.
PCT International Search Report and Written Opinion of the International Searching Authority for PCT/US09/35331, dated Feb. 23, 2010, 10 pages.
PCT International Search Report and Written Opinion of the International Searching Authority for PCT/US09/35275, dated Feb. 25, 2010, 13 pages.
GenBank: E17054.1 Direct Submission Alicyclobacillus acidocaldarius genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2 &tool=EntrezSystem2.PEntrez.Sequence.Sequence_ResultsPanel. Sequence_RVDocSum], 3 pages.
GenBank: E17054.1 Direct Submission Alicyclobacillus acidocaldarius genomic DNA clone pOP3 containing acyl carrier protein gene. Nov. 5, 2005 [Retrieved from the Internet Jan. 23, 2010: http://ncbi.nlm.nih.gov/nuccore/E17054.1?ordinalpos=2 &tool=EntrezSystem2.PEntrez.Sequence.Sequence_ResultsPanel.Sequence_RVDocSum], 1 page.
Hulsmann et al., "Maltose and maltodextrin transport in the thermoacidophilic gram-positive bacterium Alicyclobacillus acidocaldarius is mediated by a high-affinity transport system that includes a maltose binding protein tolerant to low pH," J. Bacteriol. 2000, 182(22):6292-6301.
Jones et al., "Cloning and transcriptional analysis of the Thermoanaerobacter ethanolicus strain 39E maltose ABC transport system," Extremophiles 2002, 6:291-299.
Schafer et al., "X-ray Structures of the Maltose-Maltodextrin-binding Protein of the Thermoacidophilic Bacterium Alicyclobacillus acidocaldarius Provide Insight into Acid Stability of Proteins," J. Mol. Biol. 2004, 335:261-274.
Scheffel et al., "Functional reconstitution of a maltrose ATP-binding cassette transporter from the thermoacidophilic gram-positive bacterium Alicyclobacillus acidocaldarius," Biochem Biophy Acta, 2004, 1656(1):57-65.
Schneider, "Import of solutes by ABC transporters—the maltose system. ABC protein: from bacteria to man," Elsevier Science, London 2003, p. 157-185. [Retrieved from the Internet on Jan. 24, 2010; <http://www2.hu-berlin.de/biologie/baktphys/paper/1_ABC/review_chap-09.pdf].
Uniprot Direct submission Q9RHZ5_ALIAC, "Putative maltose transport membrane protein malF," Nov. 13, 2007. [Retrieved from the Internet Jan. 22, 2010: <http://www.uniprot.org/uniprot/Q9RHZ5.txt?version=30?].
Lauro et al., "Isolation and characterization of a new family 42 beta-galactosidase from the thermoacidophilic bacterium Alicyclobacillus acidocaldarius: Identification of the active site residues," Biochemica et Biophysica Acta 1784 (2008) 292-301.
Barany, F., 1911, PNAS. USA, 88: 189-193.
Bertoldo et al., 2004, Eng. Life Sci., 4, No. 6.
Blast Search of Seq. ID. 36, accessed Apr. 22, 2009, 54 pages.
Blast Search of Seq. ID. 456, accessed Apr. 22, 2009, 48 pages.
Blast Search of Seq. ID. 458, accessed Apr. 22, 2009, 59 pages.
Blast Search of Seq. ID. 460, accessed Apr. 22, 2009, 37 pages.
Blast Search of Seq. ID. 462, accessed Apr. 22, 2009, 35 pages.
Blast Search of Seq. ID. 464, accessed Apr. 22, 2009, 45 pages.
Borman, S., 2006, Glycosylation Engineering. Chem. Eng. News, 84(36): 13-22.
Buckholz, R. G., 1993, Yeast systems for the expression of heterologous gene products. Curr. Op. Biotechnology 4: 538-542.
Burg, J. L. et al., 1996, Mol. and Cell. Probes, 10: 257-271.
Chu, B. C. F. et al., 1986, NAR, 14: 5591-5603.
Duck, P. et al., 1990, Biotechniques, 9: 142-147.
Edwards, C. P., and Aruffo, A., 1993, Current applications of COS cell based transient expression systems. Curr. Op. Biotechnology 4: 558-563.
Erlich, H.A., J Clin. Immunol., Nov. 1989; 9(6):437-47.
Garrote, G, H Dominguez, and JC Parajo, 2001, Manufacture of xylose-based fermentation media from corncobs by posthydrolysis of autohydrolysis liquors, Appl. Biochem. Biotechnol., 95:195-207.
Guateli, J. C. et al., 1990, PNAS. USA, 87: 1874-1878.
Hamelinck, CN, G van Hooijdonk, and APC Faaij, 2005, Ethanol from lignocellulosic biomass: techno-economic performance in short-, middle-, and long-term, Biomass Bioenergy, 28:384-410.
Huygen, K. et al., 1996, Nature Medicine, 2(8): 893-898.
Jeffries, 1996, Curr. Op. in Biotech., 7:337-342.
Kievitis, T. et al., 1991, J. Virol. Methods, 35: 273-286.
Walker, G. T. et al., 1992, NAR 20: 1691-1696.
Walker, G. T. et al., 1992, PNAS. USA, 89: 392-396.
PCT International Search Report and Written Opinion of the International Search Authority for PCT/US09/35307, dated Jun. 10, 2010, 10 pages.
Broun et al. "Catalytic Plasticity of Fatty Acid Modification Enzymes Underlying Chemical Diversity of Plant Lipids" Science vol. 282 Nov. 13, 1998 pp. 1315-1317 (4 pages).
Devos et al. "Practical Limtis of Functiona Prediction" Proteins: Structure, Function, and Genetics 41 (2000) pp. 98-107 (10 pages).
Seffernick et al. "Melamine Deaminase and Atrazine Chlorohydrolase: 98 Percent Identical but Functionally Different" Journal of Bacteriology vol. 183, No. 8, Apr. 2001 pp. 2045-2410 (6 pages).
Whisstock et al. "Prediction of Protein Function from Protein Sequence and Structure" Quarlty Reviews of Biophysics 36, 3 (2003) pp. 307-340 (35 pages).
Witkowski et al. "Conversion of a β-Ketoacyl Synthase to a Malonyl Decarboxylase by Replacement of the Active-Site Cysteine with Glutamine" American Chemical Society, Biochemistry, vol. 38, No. 36, 1999 pp. 11643-11650 (8 pages).
International Search Report and Written Opinion of the International Search Authority for PCT/US09/32333, mailed Jun. 19, 2009, 9 pages.
PCT International Search Report and Written Opinion of the International Search Authority for PCT/US10/25521, dated Jul. 14, 2010, 12 pages.
UniProtKB/TrEMBL Q9JRQ1 [online]. Oct. 1, 2000. Available on the internet at <<URL://http://www.uniprot.org/uniprot/Q9JRQ1>>.
PCT International Search Report and Written Opinion of the International Searching Authority for PCT/US09/00442, dated May 18, 2009, 8 pages.

FIG. 1

```
ref|NP_623417.1|        ------------------------YAYLSPAILSMTVLSFAPMAYTIYIAFTNFNLYHFK
ref|YP_001662812.1|     ------------------------YAYLSPAILSMTVLSFAPILYTIYIAFTNFNLYHFK
ref|YP_001179257.1|     ------------------------IGYVYLAPALISMAVLSFFPIAMTVYYAFTNFNLNHME
ref|YP_699602.1|        ------------KKQKRLKDTIKAMPYLLPALISIIIFTIIPIVYTVVIAFTDYTMYSQG
emb|CAB65652.1|         MATVMEMRRSHGRERAKRRVDWVAYGYLSPALVTICVLSILPIFYTIYISFTNFNQMHFL
RAAC00572               MATVMEMRRSHGRERAKRRVDWVAYGYLSPALVTICVLSILPIFYTIYISFTNFNQMHFL
                                                ** **::::  ::::  *:   *:  :**::.

ref|NP_623417.1|        NYQFVGFKNFVDILT--GPFKNVFAPVFVWTVIYALSATLLSYIVGLLLAVILNNKHMWE
ref|YP_001662812.1|     NYQFVGFKNFVDILA--GPFKVVFAPVFVWTVIFALSATLLSYIIGLLLAVILNNKNMWE
ref|YP_001179257.1|     DYKFVGFKNFVDIIT--GPFKEVFAPTFAWTFTFALITVLINFAVGLLLAVLLNNKFMKE
ref|YP_699602.1|        HIKFVGFANFIEVLT--GPFKEVFLPVFVWNIIFAVVSTAGTFFLGLIVAMAVNNPNIKE
emb|CAB65652.1|         SYQFVGLKNYEELLNPHDPLSNLFLPTFIWTLVYALCTTALAYLVGLFLAVLLNNKHMRE
RAAC00572               SYQFVGLKNYEELLNPHDPLSNLFLPTFIWTLVYALCTTALAYLVGLFLAVLLNNKHMRE
                         :***: *:  :::   .*:. :* *.* *.. :*: :.   : :**::*: :**   : * ref|NP_623417.1|        TNFYRAILIIPWGLPGTIAVLTWTGLLNQQYGGIN-LILQKLH-LPMIPWLLEPFWAKVA
ref|YP_001662812.1|     TNLYRAILIIPWGLPGTIAALTWTGLLNQQYGGIN-LILQKLH-LPMIPWLLDPFWARVA
ref|YP_001179257.1|     TNIYRSILIIPWAIPGTIASLAWQGLLNEEYGAIN-MLLK-TFRLNPIPWMTDPFWAKIS
ref|YP_699602.1|        KSVYRAILIIPWALPATVAILSWQGLLNGSYGAINNLLLNLHLISNPIPWLTDPTWARVA
emb|CAB65652.1|         RTLYRTLLIVPWAVPNLISMLAWQGLLNDQYGQIN-ALLHGVFGLPRIPWLTSALWARIA
RAAC00572               RTLYRTLLIVPWAVPNLISMLAWQGLLNDQYGQIN-ALLHGVFGLPRIPWLTSALWARIA
                         ..**:**:**.:*   ::  *:* **** .** **   :*:         ***:  .. **:::

ref|NP_623417.1|        IIMVSVWMGYPFMMNASLGALQAIPPELYEVADIDGASWFQKLTKITLPMLTSSTLPLII
ref|YP_001662812.1|     IIIVSVWMGYPFMMNASLGALQAIPPELYEVADIDGATWFQKFRMITVPMLTSSTLPLII
ref|YP_001179257.1|     IFIVNLWLSYPFMMNASLGALQSIPPELYEVAEIDGAGWFTKLFKITIPMIVPTALPILI
ref|YP_699602.1|        LIIVNIWLGFPYMMNVCLGALGAIPDSYYEAADVDGASKWLQFRKITLPSLAQISYPLLI
emb|CAB65652.1|         VIMVNVWAGFPYMMTVCLGALQSIPTDQYEAAEIDGANWWQVFRYVTMPSVWRISLPLLI
RAAC00572               VIMVNVWAGFPYMMTVCLGALQSIPTDQYEAAEIDGANWWQVFRYVTMPSVWRISLPLLI
                         :::*.:*  .:*:...    .  **.*::***     :    :*:*  :   : *::* ref|NP_623417.1|        SSFAYNFNNFGTAFLITGGGPPRTDTSFAGHTDILVSAAYKLTMQANRYDLAAALSIIIF
ref|YP_001662812.1|     SSFAYNFNNFGAAFLITGGGPPRTDTSFAGHTDLLVSSAYKMTMQFNRYDLAAALSIIIF
ref|YP_001179257.1|     SSFAYAFNNFNVVYLVTGGGPARLDTQFAGHTDLLVSTTYKLTMQFYRYDLASAMSIIIF
ref|YP_699602.1|        SSFAFNFNNFGSAFLITKGGPPRMSTQFAGYTDILASVNYKLSTQFGRFEIASAISIIIF
emb|CAB65652.1|         PSFSYNFNNFNASYLLTGGGPPNSNNPFLGQTDILATAAYKMTLTFNRYDLGATISVLLF
RAAC00572               PSFSYNFNNFNASYLLTGGGPPNSNNPFLGQTDILATAAYKMTLTFNRYDLGATISVLLF
                         .:: **.  :*:* ***.. .. * * **:*.: **::     *:::.:::*:::* ref|NP_623417.1|        LIIGTLSLLNMRLTGAFKEVD-
ref|YP_001662812.1|     LIIGTLSLINMKMTRAFEEVD-
ref|YP_001179257.1|     FIVGTISLINMKLTRAFE----
ref|YP_699602.1|        LILGTISYYQMKLSGQFEEVE-
emb|CAB65652.1|         ILVALISWVQMRYTGAFKEVDA
RAAC00572               ILVALISWVQMRYTGAFKEVDA
                         :::. :*  :*: :    *:
```

FIG. 2A

```
emb|CAB65651.1|        MSVRRWGIVSTGVAALVLAGGAIAGCGTSNGGQNTSPSTSSSSAKGEASALPKGQTITVW
RAAC00573              MSVRRWGIVSTGVAALVLAGGAIAGCGTSNGGQNTSPSTSSSSAKGEASALPKGQTITVW
pdb|1URD|A             ------------------------------------------------------QTITVW
pdb|1URG|A             --------------------------------------------AKGEASALPKGQTITVW
ref|YP_001662811.1|    --------------------------------------------SSGQTEQKKEPVELIVW
ref|NP_623418.1|       -----------------------------------------------------------LIVW
                                                                             : **

emb|CAB65651.1|        SWQTGPELQDVKQIAAQWAKAHGDKVIVVDQSSNPKG-FQFYATAARTGKGPDVVFGMPH
RAAC00573              SWQTGPELQDVKQIAAQWAKAHGDKVIVVDQSSNPKG-FQFYATAARTGKGPDVVFGMPH
pdb|1URD|A             SWQTGPELQDVKQIAAQWAKAHGDKVIVVDQSSNPKG-FQFYATAARTGKGPDVVFGMPH
pdb|1URG|A             SWQTGPELQDVKQIAAQWAKAHGDKVIVVDQSSNPKG-FQFYATAARTGKGPDVVFGMPH
ref|YP_001662811.1|    SHLTDPEIAKVQEIANKWAEQTGNKVKVLADQSD----FQAFSTAAQSGKGPDIMFGLPH
ref|NP_623418.1|       SHLTDPEIAKVQEIANKWAEQTGNKVKVLADQSD----FQAFATAAQSGKGPDIMFGLPH
                       *  *.**: .*::** :**:  *:** *: :.*:    ** ::***:*****:**:**

emb|CAB65651.1|        DNNGVFAEEGLMAPVPSGVLNTGLYAPNTIDAIKVNGTMYSVPVSVQVAAIYYNKKLVPQ
RAAC00573              DNNGVFAEEGLMAPVPSGVLNTGLYAPNTIDAIKVNGTMYSVPVSVQVAAIYYNKKLVPQ
pdb|1URD|A             DNNGVFAEEGLMAPVPSGVLNTGLYAPNTIDAIKVNGTMYSVPVSVQVAAIYYNKKLVPQ
pdb|1URG|A             DNNGVFAEEGLMAPVPSGVLNTGLYAPNTIDAIKVNGTMYSVPVSVQVAAIYYNKKLVPQ
ref|YP_001662811.1|    DNLGTFQKAGLLAEVPDGVINKDDYVPMSISAVSYDGKMYAVPISMETYALFYNTDKVPT
ref|NP_623418.1|       DNLGTFQKAGLLAEVPEGVINKDDYVPMSISAVSYDGKMYAVPIAMETYALFYNTDKVKT
                       ** *.* : **:* .:*.. *.* :*.*:. :*.:::::. *::**.. * emb|CAB65651.1|        PPQTWAEFVKDANAHGFMYDQANLYFDYAIIGGYGGYVFKDNNGTLDPNNIGLDTPGAVQ
RAAC00573              PPQTWAEFVKDANAHGFMYDQANLYFDYAIIGGYGGYVFKDNNGTLDPNNIGLDTPGAVQ
pdb|1URD|A             PPQTWAEFVKDANAHGFMYDQANLYFDYAIIGGYGGYVFKDNNGTLDPNNIGLDTPGAVQ
pdb|1URG|A             PPQTWAEFVKDANAHGFMYDQANLYFDYAIIGGYGGYVFKDNNGTLDPNNIGLDTPGAVQ
ref|YP_001662811.1|    PPATLDDLIKLGKEVGFQYDVNNFYFSFAFISAYGGYVFKDTGGGLDPNDIGLNNDGAKK
ref|NP_623418.1|       PPATLDDLIKLGKEVGFQYDVNNFYFSFAFIAAYGGYVFKDTGGGLDPNDIGLNNEGAKK
                       ** *   :::*  .: ** ** *:**.:*:*..******.* ****:***:. ** :

emb|CAB65651.1|        AYTLMRDMVSKYHWMTPSTNGSIAKAEFLAGKIGMYVSGPWDTADIEKAKIDFGVTPWPT
RAAC00573              AYTLMRDMVSKYHWMTPSTNGSIAKAEFLAGKIGMYVSGPWDTADIEKAKIDFGVTPWPT
pdb|1URD|A             AYTLMRDMVSKYHWMTPSTNGSIAKAEFLAGKIGMYVSGPWDTADIEKAKIDFGVTPWPT
pdb|1URG|A             AYTLMRDMVSKYHWMTPSTNGSIAKAEFLAGKIGMYVSGPWDTADIEKAKIDFGVTPWPT
ref|YP_001662811.1|    GLELIKDFVTKYKFMPADINGDMAKGNFQSGKTGLYISGPWDVDGFKKANVPFKVAPLPQ
ref|NP_623418.1|       GLELIKDFVQKYKFMPPDINYDMAKGNFQSGKIGLYISGPWDVDGFKKANVPFKVAPLPK
                       .  *::*:* **::*... *  .:**.:* :** *:*:***.  .:::: * *:* * emb|CAB65651.1|        LPNGKHATPFLGVITAFVNKESKTQAADWSLVQALTSAQAQQMYFRDSQQIPALLSVQRS
RAAC00573              LPNGKHATPFLGVITAFVNKESKTQAADWSLVQALTSAQAQQMYFRDSQQIPALLSVQRS
pdb|1URD|A             LPNGKHATPFLGVITAFVNKESKTQAADWSLVQALTSAQAQQMYFRDSQQIPALLSVQRS
pdb|1URG|A             LPNGKHATPFLGVITAFVNKESKTQAADWSLVQALTSAQAQQMYFRDSQQIPALLSVQRS
ref|YP_001662811.1|    V-DGKPMPSFAGVQAAFVSANSKHQQEAWDLMKYLAENTGLPL-FETGNRIPALKSLLDN
ref|NP_623418.1|       I-DGKPTPSFAGVQAAFVSANSKHQKEAWDLMKYLVENTGLPL-FETGNRIPVIKSLLDN
                       : :**  ..* ** :***. :**  *  *.*:: *..  . : *. ..::**.: *:  .

emb|CAB65651.1|        SAVQSSPTFKAFVEQLRYAVPMPNIPQMQAVWQAMS-ILQNIIAGKVSPEQGAKDFVQNI
RAAC00573              SAVQSSPTFKAFVEQLRYAVPMPNIPQMQAVWQAMS-ILQNIIAGKVSPEQGAKDFVQNI
pdb|1URD|A             SAVQSSPTFKAFVEQLRYAVPMPNIPQMQAVWQAMS-ILQNIIAGKVSPEQGAKDFVQNI
pdb|1URG|A             SAVQSSPTFKAFVEQLRYAVPMPNIPQMQAVWQAMS-ILQNIIAGKVSPEQGAKDFVQNI
ref|YP_001662811.1|    PEVKNNEILNAFAEQATHAIPMPNIPQMAAVWTPAGNALQLITSGKVPVDKAADDMVNQI
ref|NP_623418.1|       PEVKGNEILSAFAEQAQHAIPMPNIPQMSQVWTPAGNALQLITSGKVPVDKAADDMVKQI
                       . *::  :.**.**.** **  . . **  *  **  : *** :::.*.::*::
```

FIG. 2B

```
emb|CAB65651.1|         QKGIMAQGS
RAAC00573               QKGIMAQGS
pdb|1URD|A              QKGIMA---
pdb|1URG|A              QKGIMAQGS
ref|YP_001662811.1|     KQGIATQ--
ref|NP_623418.1|        KQGI-----
                        ::**
```

FIG. 3A

```
ref|NP_391276.1|         --------------------SMGFVILISCAAGLGGLLYGYDTAVISGAIGFLKDLYSL
ref|YP_001422694.1|      --------------------QHSKWFVILISCAAGLGGLLYGYDTAVISGAIGFLKDLYRL
ref|NP_347967.1|         --------------------SLLFIVLISCAAGLGGLLYGYDTAVISGAIGFLKKLYNL
RAAC00608                MADVVPTPWRRFAMSTQQTQGSRAYAVTISLAAAMGGLLYGYDTAVISGAIGFLKTLYHL
ref|YP_804553.1|         ------------------------YVILISCAAALGGLLFGYDTAVISGAVGFLQIKFTL
ref|ZP_01886765.1|       -----------------QGSKSGTYLYLICLVAALGGFLFGFDTAVISGTVSLVKTDFDL
                                              :  *. .*.:**:*:*:******::.::   : * ref|NP_391276.1|         SPFMEGLVISSIMIGGVVGVGISGFLSDRFGRRKILMTAALLFAISAIVSALSQDVSTLI
ref|YP_001422694.1|      SPFMEGLVISSIMIGGVFGVGISGFLSDRFGRRKILMAAALLFAVSAVVSALSQSVSSLV
ref|NP_347967.1|         SPAMQGFVISSIMVGGVLGVGFSGFLGDAIGRRKVLMLAAALFAISAVISSISTSAFMLI
RAAC00608                SPFMQGLVISSIMIGGVIGVAVSGFLSDRVGRRKVLMTAAVLFAVAAFVSAISSDVTTLI
ref|YP_804553.1|         SSAQVGWVTSCILIGCALGVSIAGILSDLFGRKKILALSAVIFALSSLGAAFAGSYMILV
ref|ZP_01886765.1|       NAVSEGWFVSCALLGCIIGVSFSGKLSDRYGRKIVLILSAVLFLASALGCMISSSFDVLI
                         ..  *. .*. .**..:*  .**..:*  *.*  **  :*   :*  :* ::. . ::  *:

ref|NP_391276.1|         IARIIGGLGIGMGSSLSVTYITEAAPPAIRGSLSSLYQLFTILGISATYFINLAVQRSGT
ref|YP_001422694.1|      IARVIGGLGIGMGSSLSVTYITEAAPPAIRGSLSSLYQLFTILGISGTYFINLAVQQSGS
ref|NP_347967.1|         FARIVGGLGIGMASALSVTYITECAPPSIRGRLSSLYQLFTILGISITFFVNLGIVNMGS
RAAC00608                LARIVGGLGIGMGSALSVTYISECAPTQIRGALSSLYQLLTIIGIFLTYLTNYLIQRSGS
ref|YP_804553.1|         IWRMLAGIGIGLTSLITPLYIAEMAPSNVRGKLVSVNQLAITIGIFIVYFVNAAIASNAT
ref|ZP_01886765.1|       IFRLIGGLGIGVASMVSPLYISEFSPSRYRGMMVSLYQLALTIGIVLAYFSNAYL--ANH
                         : *::.:.***:  *  :: **:* :*. **  *: **  :**    .:: *   :

ref|NP_391276.1|         YEWGVHTG----------WRWMLAYGMVPSVIFFLVLLVVPESPRWLAKAGKTNEALKIL
ref|YP_001422694.1|      YEWGVHTG----------WRWMLAYGMIPSVIFFIVLLIVPESPRWLAKAGRRNEALAVL
ref|NP_347967.1|         ETWRVSTG----------WRYMLACGTVPAIVFLITLFFVPESPRFLVKSGNIKKAAAVL
RAAC00608                VAWDVHTG----------WRWMLGLGCVPAAIFFFVLLFAPESPRWLAKVGRIDEALRIL
ref|YP_804553.1|         QLWNVSTG---------WRWMMGVGVIPSLLFLIALIPAGESPRWLSQHGKSEAAYKVL
ref|ZP_01886765.1|       ISDDYGTGSMQTIFSVEVWRGMLGLGAIPAAIFLISLFFVPESPRWLLLRGKDQKARQVL
                                            *:. * :*:  :*::  *:   ****:*    *. .*  :* ref|NP_391276.1|         TRIN-GETVAK-EELKNIENSLKIEQMGSLSQLFKPGLRKALVIGILLALFNQVIGMNAI
ref|YP_001422694.1|      TRIN-GEQTAK-EEIKQIETSLQLEKMGSLSQLFKPGLRKALVIGILLALFNQVIGMNAI
ref|NP_347967.1|         TKIN-GAEIAK-QELDSISKSLATENDSSLGQLLQPGLRRALLIGIFLAIFNQAIGMNSI
RAAC00608                VRIN-GPSAGQ-RELESIRESIASESAASIRDLLKPGWRKALGVGILLALFNQIIGMNAV
ref|YP_804553.1|         QKVEISDEAAE-KSLEEIQMSEEVVDDTKFRDLFNKTWLPVLIIGVLLALFQQFSGSNAI
ref|ZP_01886765.1|       VKID-GAPAAD-REIAAFKAQDDNVEG-SLKELFRPVFRKALYIGILLPFLSQICGINAV
                           ::: .     .. ..:  ?  .   .: :*:.       .* :*::*.::.*  *  *::

ref|NP_391276.1|         TYYGPEIFKMMGFGQNAGFVTTCIVGVVEVIFTVIAVLLIDKVGRKKLMSIGSAFMAIFM
ref|YP_001422694.1|      TYYGPEIFKMMGFGQNAGFITTCIVGVVEVIFTIIAVLLVDKVGRKKLMGVGSAFMALFM
ref|NP_347967.1|         TYYGPEIFQMIGFKNNSSFLATSVIGVVEVFSTILAMFLIDKLGRKKLMEIGSAAMAVFM
RAAC00608                TYYGPEIFRMVGFSLNSDFEIQAFFGAMWVVFTVVAVVLIDRVGRKPLMIVGSALMAIFM
ref|YP_804553.1|         MYYAPEIFKGAGFGQSGAFMATVSIGVINMVITIVALGLVDKIGRKKLLGWGSFAMSCCL
ref|ZP_01886765.1|       IYYGPEIFRILEQAGFTLNNALGGQVTIGLVNVVFTFVAIFTIDKWGRKPLLFVGVGGAVISL
                         **.*.*:.  **   .  :    .*  : :. *.:*:  :*: *** *:   *      :

ref|NP_391276.1|         ILIGTSFYFELTSGIMMIVLILGFVAAFCVSVGPITWIMISEIFPNHLRARAAGIATIFL
ref|YP_001422694.1|      ILIGASFYFQLASGPALVVIILGFVAAFCVSVGPITWIMISEIFPNHLRARAAGIATIFL
ref|NP_347967.1|         LLIGTSFYIKLSNGFVILIFIICFVVSFCISMGPIPWIMIPEIFPNHLRARATGIATIFL
RAAC00608                ALMGLTFYLHVHNGFWLVLFIMGFTAAFSVSMGPIPWIMIPEIFPNHLRARAAGVATIFL
ref|YP_804553.1|         LVVSICFFVHAATSITLT-FVLLAIAAYAVSLAPVTWILISEIFPLKIRGRAMSICTAVL
ref|ZP_01886765.1|       IIIGVLFALGVTAGPWILIFILAFIACFAFSFGPVCWVVVGEIFPNAVRGKAMALATLSL
                         ::. *  .   . :  :::   ..:..*..*: *:::  ****  :*:*  ::.* *
```

FIG. 3B

```
ref|NP_391276.1|         WGANWAIGQFVPMMIDSFGLAYTFWIFAVINILCFLFVVTICPETKNKSLEEIEKLWI--
ref|YP_001422694.1|      WGANWAIGQFVPMMISGLGLAYTFWIFAVINILCFLFVVTICPETKNKSLEEIEKLWI--
ref|NP_347967.1|         WGANWAIGQFTPMLLNGIGGAYTFWIFCGINVICFLVVTTKVPETKNKSLEEIEKFWIPK
RAAC00608                WGANWAIGQFTPVLLNDFGGAYTFWMFAVINILGVLFVTAWVPETKNRSLEEIESIWMAS
ref|YP_804553.1|         WLSDFTLSYTFPILTQNIGEGWTFMLYVVVTALSAIFVWKLVPETRGKSLEEIEVYWHAK
ref|ZP_01886765.1|       WIGNFLVGQLTPVLLEGLGSSWTFFLFAICCSPALWITWKLIPETKGRSLEDIENYWKKS
                         *  .::  :.    *::  ...:*  .:  ::          ..   *:.:*:   * ref|NP_391276.1|         --------------------
ref|YP_001422694.1|      --------------------
ref|NP_347967.1|         SK------------------
RAAC00608                GRGVSLSQRDAHERAKRAHF
ref|YP_804553.1|         SK------------------
ref|ZP_01886765.1|       --------------------
```

FIG. 4A

```
ref|YP_147976.1|        ----------------------------------------------------------
ref|YP_001126119.1|     ----------------------------------------------------------
ref|YP_001662045.1|     ----------------------------------------------------------
ref|YP_001409972.1|     ----------------------------------------------------------
ref|YP_001108359.1|     ----------------------------------------------------------
RAAC00626               MQMKSKVKRWTSVALASSAAAALVVGCGQPNNTASQTSTNGSASTAASSASTVSVAGVRI ref|YP_147976.1|        ---------------IVYARGQDSTKATEKIIEAFEKTHPNIDVEFREMP-ADTGKQHDA
ref|YP_001126119.1|     ---------------IVYARGQDSTKATEKLIEAFEKAHPNIDVELREMP-ADTGKQHDA
ref|YP_001662045.1|     ----------KNEPITITYSTGKDSTPATQKLVEAFEKKYPNIKVKVQELP-NSTDDQHNS
ref|YP_001409972.1|     ---------------TMTAGAVGKELEVLYAQLDRFMKANPDIKVSVMPMP-NSSTERHDL
ref|YP_001108359.1|     ------------------------LVDAFRAAHPNITVRIAQAP-PTTDVQRAT
RAAC00626               AKPTHLVNYKNASGTIVWAESFTTGPTASELVSAFEKKYPKIKVKLQVQP-SNTDTNRAD
                                                 :.  *    *.* * .   *      :   .:

ref|YP_147976.1|        YVTMLNAQSSEIDVMDLDVIWPAEFAQAGYTLPLDRFIEKDGIDLG---KYNQGALAAGN
ref|YP_001126119.1|     YVTMLNAQSSEIDVMDLDVIWPAEFAQAGYTLPLDRFIEKDGIDLS---KYNQGALAAGN
ref|YP_001662045.1|     YVTALSAGDSSIDVLAMDIIWTPEFAAANWLLPLDDKFTK---EMR--DKFLPGPVEAVT
ref|YP_001409972.1|     YVTTYLASGEKEPTVLMLDVIWPAEFA--PYLEDLT--ADKDYFELS---KFLPGTVKAAT
ref|YP_001108359.1|     LTTQIASGAPRPDVYLGDCVWPAQFAHNSLATPLDTLVEP-----GFWDDFAEPVVTSLT
RAAC00626               LTASISGGSSTPDVYMGDVIWPAQFAHNQLAAPLSDDLPT-----SFWTRFSNGLVAGAT
                        .: : .        *   *  :*..:**    *           :      :    .

ref|YP_147976.1|        FNGKQWAMPKFIDAGMLFYRTDLVPKDK---VPKTWDELLKEAKELKGKGGTKFGYLMQA
ref|YP_001126119.1|     FNGKQWAMPKFIDTGMLFYRTDLVPEDK---VPKTWDELLKTAKELKGQGGTKFGYLMQA
ref|YP_001662045.1|     YNGHVWAVPRFTDAGVLYYRKDIID-----TPPKTWDELIQMAKENVGKGGTKYGIVFQG
ref|YP_001409972.1|     VGGKTVAVPWFTDAGLLYYRKDLLQKYGFKEAPKTWDELVKMAKTITAKEKNMVGFVWQG
ref|YP_001108359.1|     YEDRRWAFPLYLSESFLYYRADLLAKHG-IAVPRTWEELTRAARALTATGDVRYGLSWQA
RAAC00626               YNGKVYAAPLFADTAFLYYRKDLLAKYH-LPVPKTWQQLQTEASYIVKHGGAKYGFVWQG
                         .:   *  * :   ..*:** *::     *:**:* *         *       * *.

ref|YP_147976.1|        KQYEGLVCNAVEFIASYGGQIVD-KNGNVVINSPETIKGLKKMVEIVKSD-VVPSNITTF
ref|YP_001126119.1|     KQYEGLVCNAVEFIASYGGQIVD-KDGNVVVNSPEAIKGLKKMVEIVQSD-VVPSNVTTF
ref|YP_001662045.1|     NQYEGLVCDALELIGSNGGSVLE-GD-KVTIDTPQAVAGLQYLIDLVK---IAPPGVTTY
ref|YP_001409972.1|     ARYEGLVCDFMEYLVSFGGDVLD-DAGNVVVNSPAAVKALQFMVDLIYKEKVSPQAVTTY
ref|YP_001108359.1|     APSETLTCNVAEFVADAGGGELVAPDYSRATLDSAAGRRALGFVEELVGTG-VSPRSVATF
RAAC00626               ADYEGLTCDFDEYLADAGGSVLT--NGKATLNTAAAKQALSFMRGLITSG-ATPQSVDTF
                           *  *.*:    *  :  . **.::      ...::.   .*    : ::    * : *:

ref|YP_147976.1|        TEPESHTAFIEGQSPFIRNWPYQYALANDKEQSKIVGKVGVAPLP----AGDKGSA-AAL
ref|YP_001126119.1|     MEPESHTAFIEGQAPFIRNWPYQYALANDQEQSKIVGKVSVAPLP----AGDKGSA-AAL
ref|YP_001662045.1|     QEEDARNVFQQGEAIFMRNWPYAWS-LVNGDDSPVKGKVGIAPIPR-GKDGEVGTP--VL
ref|YP_001409972.1|     MEEEARRKFQNGEAVFMRNWPYAWALLNDPKESKVAGKVGVAPLP----AGPSGKSAATL
ref|YP_001108359.1|     SEQQESLTTFTGQNAAFLRNWAYAWGTAQDPSDSQVSGRIGATFRPT--FDGATRSRVSTV
RAAC00626               QEPSENVFTQGNAVFLRNWSYAWSDSQNPQSSKVVGKVGVAPLPT--FAGHGSSGYSTV
                        *  ::    *  *::  *:***.*  :.        :  .* : *::. :         . .:

ref|YP_147976.1|        GGWMTAINKYSKHPK--EAWEFVKFMTGPEGQKISAIYGGLAPTLPELFKDPDVLKANPF
ref|YP_001126119.1|     GGWMTAINKYSKHPK--EAWEFVKFMTGPEGQKISAVYGGLAPTLPELYEDEEVLKANPF
ref|YP_001662045.1|     GGWNLGINKYSKHPE--EAWKFIEFVTSEEGQKVTALEGGNLPTIKSLYQDKEVLAKNPY
ref|YP_001409972.1|     GGWMLGINKNATPEEKAAAKKLVKFLTSYDEQLYKAINAGQNPTMMDVYKNPELKKAAPF
ref|YP_001108359.1|     GGWHNFVNPHTEQLG--AAVAFARWMSGVDAQLILGMRSTQLPASLTAVNDPRIRQNDNP
RAAC00626               GGWDLYLNPHTKNLA--AALQFIDWMTSPQAQEILAANSEMP--TIKAVADSPSLAKYSP
                        ***   :* :           *   :  :::.   :  *        . .           :
```

FIG. 4B

```
ref|YP_147976.1|        FAEEGFVNALNAAVPRPV-VPNYPEISEIIQINVSKALAGELTVEQAVANMEKEMKAAL-
ref|YP_001126119.1|     FAEKGFVNALNAAVPRPV-VPNYPEISEIIQINVSKALAGELTVEQAVANMEKEMKAAM-
ref|YP_001662045.1|     WAD--FYDVFITAKPRPV-SPFYPQMSDSMQINFHKALTGEITAQQAIQNIAKDLNDII-
ref|YP_001409972.1|     MVE--LYGMFINAVPRP-RTAKYSEISDVIQKYVHAALTQQTTAQKAIEDMAKELNKVL-
ref|YP_001108359.1|     VLR---MVPEVDLAPRPTRTPYYPQVSEAVYSNINPVVAGSSDPGAVLAKVSSEIDFAL-
RAAC00626               VFA---LLPQVKFVSRPAQTPNYPAVSKAIYDNVNAALAGSVSVAQALKNANQQIQQALS
                          .**    . *. :*. :    .    .::      .: .  .::.  :

ref|YP_147976.1|        -------
ref|YP_001126119.1|     -------
ref|YP_001662045.1|     -------
ref|YP_001409972.1|     -------
ref|YP_001108359.1|     -------
RAAC00626               GSGSGGL
```

FIG. 5

```
ref|YP_001662044.1|    ------------------------------------------GYILVAPALLCIIAIALY
ref|YP_922080.1|       -------------------------GRRLRVRGGQHEGRFALLLLLPAAVVVFGVVLW
ref|ZP_01730302.1|     ---------------------------------MREENKTAWFMLIPALAVLAFVFAY
ref|YP_171303.1|       -------------------------------------------------PALLTITGVFAY
ref|YP_001108360.1|    ----------------------------------------RLGWLYTAPALIVVVAVTIF
RAAC00627              MSTMLASEGEGRRARMSKAMEGHASFQTDGRRASVVRHDVRAGFGMLTPAGIVILAVTIF
                                                                        **   :    :    :

ref|YP_001662044.1|    PVLNTFKLSL----YYMKLQLPGLTH-FVGLQNYITLSSDSRFWSATLNTVFFTVVSVAL
ref|YP_922080.1|       PVVRTLVVSL----YDVDSAMPG-SYPFVGLDNYVRVFQDDRFYSVLGHTMYFTLVSTFL
ref|ZP_01730302.1|     PIGRAFWLSL----FTENLGTQ-LQPVFSGFTNYLRMAGDGRFWQSMWNTWVFTGVSVFL
ref|YP_171303.1|       PLLRAAWLSL----QALNLNTQ-LQPVFIGLANYQRLWGDSRFWGDLFNTTVFTVTSVSL
ref|YP_001108360.1|    PILFSVVLSF----TRVRVTYGGFRVEELTLDNYVALFQSSEWHYAVLFTFFYTVVTVTI
RAAC00627              PILYSVWMSF----NNIQLTENGFQFTFNGIQNYVDVYSAPLFWHSVWFTVYYSIVTVAI
                       *:    :   :*:              :  **   :       :        *   ::  .:.   :

ref|YP_001662044.1|    ELVLGMIMALLMN--KKFKGIGLVRAAVLIPWAIPTVISALMWKFIYNDQFGVLNDILMK
ref|YP_922080.1|       ELALGIAVALLLN--APLKARWLWRSIVVLPWALPTIVNGALWRWIYNGQYGALNGLLDT
ref|ZP_01730302.1|     ELVLGMIVALVLN--QAFFCRGAVRTISMIPWALPTAIMGLAWAWIFNDQYGVVNDILQR
ref|YP_171303.1|       ELVLGLAIALLLH--QPSRWRGPLRTIALLPWVLPTAVMALGWAWIFNDPYGWNDWLQQ
ref|YP_001108360.1|    ELVLGVLAALVLE--RLGAARGWVLALLLIPWSMITVISAQLWAFIYNSTYGVATWLLEA
RAAC00627              ELFLGLLIALAIQ--NVEKLKSVSVVVMLIPWSLITVISAEMWSYIYNGVYGVLNAILQG
                        :    :.                  ::    :    *   .     *   :*:*.    .*.    .    * ref|YP_001662044.1|    VGLINSYKAWLGSPSSAMSAAIFADVWKTAPFMALLLLAGLQNISQDLYEAAKVDGAGSI
ref|YP_922080.1|       LGISETPTQWLGEPFLALNMVIIADVWKNTSIVVFFILAGLQTIPSDLYEAARVDGAGPW
ref|ZP_01730302.1|     LGIINTEINWLGDPTLAMIALIVADVWKTTPFISIILLAGLQSIPKDLYEAHSLDGANPW
ref|YP_171303.1|       LGWIAAPINWLGNPRWAWLTLVAADVWKTTPFVAILLLAGRQAIPEDLYEAHCLEGATAW
ref|YP_001108360.1|    L-FGTAPII-LGTPVPAITGMMVADIWKTTPFVTIIVLAGLVMLSREVYESAEIDGANAW
RAAC00627              LGFIHSPINWTGEPVTAVIALMAADIWKTTPFVVIILLSGLQMIPKDYYEAARIDGANGW
                         :           :    *  *    *   :  **:**.:.::  :::*:*   :. :  **:   ::**

ref|YP_001662044.1|    RQFFRITLPLLKPTILVALIFRTLDAFRVFDLIFVMTGGGPGNSTETLSIYAYKTLFRNL
ref|YP_922080.1|       RAFWRLTIPMLAPSIAVVLILRTIEAFKVFDIIYVMTGGGPASGTQTIAFYTYLQAFSNQ
ref|ZP_01730302.1|     QSFYQITLPLVMPQVLIALLFRFAQAFGIFDLVQVMTGGGPAGATETVSIYIYSTVMRYL
ref|YP_171303.1|       QSFWQITLPLLRPQLAIALLFRSAQAFGLFDLVKVMTGGGPANSTETLALYAYTTALRYL
ref|YP_001108360.1|    TTFWRVTLPQLKSTLAVVLFRILQAFGVFDLPFVLTTGGPGTATQSLAILGYKTLFQDL
RAAC00627              QIFWNVTFPQLRGSIAIAGLFRILQAFGIFDLPFVLTQGGPGSTTTSLAMLGEETLFTNL
                        *:.:*:*   :        :   :.   ::*   :**   :**:     *:*  ***.   *   ::::        :

ref|YP_001662044.1|    DFGIGSAIAVIIFIFVFIFAMFYI------------
ref|YP_922080.1|       LFGYGAALAYLIVLAVFALAMAYLRILR--------
ref|ZP_01730302.1|     DFGYGAALVVITFLLLIAA-----------------
ref|YP_171303.1|       DFGYGATLAIVTAAILAAGLGLIW------------
ref|YP_001108360.1|    HIGPGAAIATSTGLLVIGGCLLFLKAFRAQVGKE--
RAAC00627              HFGLGAAVAVSTVILILGACLIFLSAFRGMVGEEAQ
                       :*  *:::.              :
```

FIG. 6

```
ref|YP_147974.1|        ----------------------------------------PFLWVLLSSIKPLSELFGD
ref|YP_001126117.1|     ----------------------------------------PFLWVLLSSIKPLSELFGD
ref|NP_694394.1|        ----------------------------------------PFIWVFLTSIKPVNEIFSS
ref|YP_001662043.1|     ------------------------KNTINQIIFYIFLTIFLVYIIFPFLWQTLTSFKTPQELFSI
ref|YP_001108361.1|     ----------------------------------------PLYWMVVNSLKGGAELGAT
RAAC00628               MSNIPVRLSRDGRGGSAMRKPLYQRIIGYVVLIFFLVVILLPFYWMFVTSFEPNSDISAY
                                                                *: *  :.*::    ::  .

ref|YP_147974.1|        KAFDWFTSHPTLKSYVSVFVNYPFLRYLWNSTVVATITTVYTVFVAAFAAYAIARLEFKG
ref|YP_001126117.1|     KAFQWFTSHPTLKSYISVFVNYPFLRYLWNSTVVATITTVYTVFVAAFAAYAIARLEFRG
ref|NP_694394.1|        FK--WFTSNPTLSSYEAALTNRPLLRYMLNSFVVSLLTTVLSLTFAAFTAYAVTRLPIKG
ref|YP_001662043.1|     PP-TWIPSKIYTGYYINVFTKRPFLTYLKNSFIVASSTTLFSLFVSSFAAYALARLKFKG
ref|YP_001108361.1|     PP-TPWPSDPTVDNYVQAFAGNGFGGYLVNSLVVSVVSTVVVVSLATFAGYALARLPMRG
RAAC00628               PP-AYFPHHWTLSHYEEAFGQFHFGRYILNSVIVSITSTFFVLLFGSMAGFAIARLPIKA
                           .  .      *   .:     *:  **  :*:   :*.    :  ..:::..*::**  ::.

ref|YP_147974.1|        KTVILGLVLAVSMFPQIATISPIYMFVKKFGLTNSYLGLIIPYTTFALPLSIWLLVTFFR
ref|YP_001126117.1|     KTVILGLVLAVSMFPQIATISPIYMFVKKFGLTNSYLGLIIPYTTFALPLSIWLLVTFFR
ref|NP_694394.1|        KGLILGLVLAASMFPQIAIISPMFNLVTNLGLRNSYLGLIIPYITISLPLAIWILSTFFK
ref|YP_001662043.1|     KAIILSLVLSVSMFPGIAIVSPLFIFLKNVNLLNSYLGLILTYTTFAIPLSLWILTSFFK
ref|YP_001108361.1|     RRPLMIALLMISVFPAIAVVTPLYLVERQLGLLNSHLGLIIPYVAFNLPLAIWIMRNYML
RAAC00628               KQPMLILLLIISVFPPLVVITPLYMLLRDVGWLDSYQALVIPYTAFNLPFAIWILRNYFL
                         :  :: :* *:**  :. ::*::  .   ...  :*:  .*::.*  :: :*:::*::  .::

ref|YP_147974.1|        KIPFDLEEAAKMDGATPMQTYFKIILPLAVPGVFTTSILVFIAAWNEFLFALTINTAEKY
ref|YP_001126117.1|     KIPFDLEEAAKIDGATPMQTYFKVILPLAVPGVFTTSILVFIAAWNEFLFALTINTAEKY
ref|NP_694394.1|        KIPYELEESAKLDGASPFQTFRKIIILPLATPGIFTTGILVFIAAWNEYLFALTINSDDQW
ref|YP_001662043.1|     EIPFELEESAKVDGATPMQAFLKIIMPLATPGMFTTAILTFIAAWNEFLFALVFNTQDSM
ref|YP_001108361.1|     GVPTALEDAATVDGASPTRTVLQIVVPVVRPGILTAAIFTFTATWTEFLMALTFNSQNDY
RAAC00628               QVPGALFEAAKIDGASVFMSYWRIFLPLTTPGLFTAAVFTFVACWTEFFMALVFNPDNTM
                         :*   *  ::*.:***:     :  ::..:*..  **:*:.::.:.* *  *.*:::**.:*.  :

ref|YP_147974.1|        KTVPVGIAMFQGQYTIPWGEISAATVIVTIPLVIMVLLFQRRIVSGLTSGSVK-
ref|YP_001126117.1|     KTVPVGIAMFQGQYTIPWGEISAATVIVTIPLVIMVLLFQRRIVSGLTSGSVK-
ref|NP_694394.1|        RTVPVGISMYQSEFSIPWGDISAATVIVTIPIVVLVLIFQRRIVSGLTSGSVK-
ref|YP_001662043.1|     RTVPVGIAMFPGEHDLPWGDIAAASVVVTVPLIIMVLIFQKRIISGLTAGAVKG
ref|YP_001108361.1|     RTIPVGISLFGSSFEVPHGTIFAAAVSATAPIAILVLVFRRSVVSGLASGAVKG
RAAC00628               RTIPVGIALFSGQYTVPYGTIFAGSVVSIVPIVILVVIFRRWIVSGLTQGAVKG
                         :*:****:::  ...  :* * * *.:*    *:  ::*::*::  ::****  *:**
```

FIG. 7A

```
ref|YP_825097.1|            -----------AVDYAILALYFAFVLGIGWRLRKKISTSGDFLTSGHSVPVWITSLAFLA
ref|YP_001108350.1|         --QVELRLDASAVDYVLLAIYFVFVLGIGYLARRSVSTSLDFFLSGRALPAWVTGLAFIA
ref|YP_644805.1|            ------------VDYLIIGIYFLFVLGIGALLRDKMRTSEDYFLSGRSLPSWVTGLAFLG
ref|YP_589403.1|            ------LVNLSSTDLVIIVFYFALVLAIGWQLKGQAKTGEDFFMAGREMTAWIAGLSFLS
ref|YP_822512.1|            ------LMTLSTVDLAIIVLYFAAVLGIGFYLKRFTKTGEDFFLAGREMTAWIAGLSFLA
RAAC00662                   MHRVHALFHANAVDYIIILVYFAFVLGVGFVLRNRVRTGEDFFLSGRSIPAWITGLAFLS
                                       .*   ::  .**  **.:*    :     *. *::  :*:  :.  *::.*:*:.

ref|YP_825097.1|            ANLGAQELVGMSGNGAKYGIMTAHFYWVGAVPAMIFVGIFMMPFYYGSRARSVPEYLKLR
ref|YP_001108350.1|         ANLGAIEIIGMSANGAEYGMPTMHYFWIGAVPAMLFLGIVMMPFYYGSKVRSVPEFMLRR
ref|YP_644805.1|            ANLGALEILGMGAGAAQYGLMQAHFYWIGAIPAMVFVALFMIPFYYGSRVHSVPGYLKLR
ref|YP_589403.1|            ANLGSLELMGWAGAAYQYGILAAHWYWIGAIPAMIFLGLVMMPFYYISKTHSVPGYLKLR
ref|YP_822512.1|            ANLGSLELMGWAASAYQYGILATHWYWIGAIPAMLFLGIVMIPFYYISKTHSVPGYLKLR
RAAC00662                   ANLGALEILGMTASGAEYGMLTTHFYWIGAIPAMLFLGLYMMPFYYVSKVRSVPEFLKLR
                            ****: *::*    . .  :**:     *:::*::*:*:.: *:****  *:.:*** ::   * ref|YP_825097.1|            FDEKTRALNALTFAGMTIFSSGISMYALGLLLRLVLGWDFTTSVLCSAAIVLAYTFLGGL
ref|YP_001108350.1|         FGKPAHLVNGISFAVAQVLIAGVNLYLLASIVNVLLGWPLWVSVLIAAAIVLSYTALGGL
ref|YP_644805.1|            YNEATRGFNAVLFAIFMILLSGINMYAMAIVFKLLLGWSLTASILLSAAITMAYILLGGL
ref|YP_589403.1|            FGEPSRSAVSFAFMTVLMSGINMYSMALVMKVVLGWDINVSIIVSSITVAIYVTLGGL
ref|YP_822512.1|            FGEPARALSAISFGLMTVFMSGINMYSMALVMKVVLGWDIHVSIWISSITVMLYVGLGGL
RAAC00662                   YNEATRALNAIAFAVMTVLTSGISLYSMALIFQILIGWSFDTSILVSALVVLIYVALGGL
                            :.:  ::   ...: *.   ::  :*:.:*  :.  :..:.::**    : .*:   ::    .  *  **** ref|YP_825097.1|            TSAIYNEVLQFFLIVMGFSPLAIMAVMKAGGWSGMSARLAQMTLPGGINGSVMTHSWKYM
ref|YP_001108350.1|         SAAIYNEVLQFFVIVAALLPLTIVGLTKVGGWEGLVAKVSAS--PG---GAEQLTAWPGN
ref|YP_644805.1|            SSSIYNEVLQFFLITLGLVPLVVFALIDVGGWAGLQEAVDRE---------GYFHLWAHT
ref|YP_589403.1|            RSAIFNEVLQFVLIWAGALLIPIMGLIEAGGWTNLKAQITRNAS-A------EYTHLWSTL
ref|YP_822512.1|            LSAIFNEVLQFVLIWLGAMLISIIGLIEAGGWDGMVAKIHANFPQG-----DYTHAWRTL
RAAC00662                   TSSIFNEVVQFFLIWAGLLPIPLIGLHNLGGWQGMMSRLPAGFG----------HLWANL
                              ::*:*:.:*      .   :  :..:    ***  .:   :                  * ref|YP_825097.1|            AHTSENPMGIEIFGLVAGLGFVMSFGYWCTDFLVIQRAMAANSMSASRRTPVIAALPKMM
ref|YP_001108350.1|         ELTGFTNSFLSVVGLVFGLGFVLSFGYWTTNFVEVQRAMASKSMSAAQRTPIIGAFPKMF
ref|YP_644805.1|            GT--TDNPMAVRWFGIVLGLGFVLSFGYWCTDFLVVQRALAAEDAAAAQRTPLIAAFPKLL
ref|YP_589403.1|            GKFSDNPMGINWIGIVFGLGAIISMGYWTTDFLVVQRVLAAKDMRSAKMAPIIGAAFKML
ref|YP_822512.1|            GSFNDNPMGINWVGIVFGLGAVISMGYWTTDFLVVQRVISAKDLRAAKLAPIIGAAFKMC
RAAC00662                   GSPSHNPMGIWLGVVLGLGFVLSFGYWTTDFLVVQRTLAAKDLRAAQLTPIYAAFFKMI
                                .  :  .*:*  *** ::*:*** *:*: :**.::::.     :::   :*:  .*   *:

ref|YP_825097.1|            MPFIVIVPGIAALALSQMGVGYDLPMKNGGPD-----YDQVLTTLMGKFYPAGMLGVGLT
ref|YP_001108350.1|         IPFLVIIPGMIAAVLVPDLSAYKATG-AGAVD-----YNDALLLLMRDLLPNGLLGIALA
ref|YP_644805.1|            YGILAIFPGLVALTIVPNLG---QGGGGLANS-----YNMAIPYAMAHYFPSGMLGLGLT
ref|YP_589403.1|            VPFIVILPGLLALAVLPMKLVGESQAIATHGH----SYNEVPLMLARYCGPGLLGLGIT
ref|YP_822512.1|            VPFIVILPGLLGLAVLPEHLLPESQALATGGH----SYNEVPIMLARYCGPGLLGLGIT
RAAC00662                   VPILVIIPGLIALAIFPK--IGHSPNMS--------YNLALPLLIAKYYPPGMLGLGLT
                              ::.*.**:    . ..:          *:  .:    :      *:**: . ::

ref|YP_825097.1|            GLMASFMSGMAGNVTAFNTVFTYDLYQTYIKPGQPDHHYLTVGRITTVVGVALSICTAYL
ref|YP_001108350.1|         GLLASFMAGMAANLSSFNTVFTYDLWQAYIVKDKPDHYYLNMGRWVTVGATVVAVGTAFI
ref|YP_644805.1|            ALLAAFMSGMAGNVTAFNTVWTYDIYRSYIRRDAPDRHYLNMGRIATVAGVVLSVGTAYI
ref|YP_589403.1|            ALIAGFMSGMAGNVSAFTTVWTYDIYRAMIKKDASDAHYVNMGRASTIGGVIISILTAYF
ref|YP_822512.1|            ALIAGFMSGMAGNVSAFATVWTYDVYRAMFNKNATDSHYVSVGRWCTFWGVLASIGTAYM
RAAC00662                   AMLASFMSGMAGNVTAFTTVWTYDIYQAYIKKDAPDKHYVNMGRWAVVVGVIISIGTAYF
                             .::*.**:***.*:::* **:***:::   :      .  .* :*:..**    ..  ::   **::
```

FIG. 7B

```
ref|YP_825097.1|         AQQYNSINDLLQLVFSFVNAPLFGTFLLGMFWKRTTGHGAFFGLLSGTAAAALTQGLTVA
ref|YP_001108350.1|      AAGYENLMDYLQQLFSFFNAPLFATFILGMFWKRMTPTAGWLGLVLGTLAAVTVFGLSEG
ref|YP_644805.1|         VLGFASIMDYVQLLHGLFLAPLFGTFLLGMFWKRTTPWGGFAGLVSGTAAGLVLYGLELL
ref|YP_589403.1|         VMKFASIMDYVQALFSFFIAPLFATVVLGMLWKRATNAGGFWGLLAGTVSSVGMYAWVKL
ref|YP_822512.1|         VMSFASIMDYVQALFSFFIAPLFGTVILGMLWKRASPAGGFWGLAAGTASSIGMWAWVKI
RAAC00662                AAGFPSVMDYMQTLFSFFNAPLFATFLLGMFWKKATPWGGFWGLLAGIAGAFAMYFFLP-
                         .  :  .: * :*  :..:. ****.*.:***:**:  :   ..: **   *   ..

ref|YP_825097.1|         EGKGGWMANLHEFPSSMAQNFWIAITAWTVCFAITIAVSMVTTPRPEKELHGLVYGLT--
ref|YP_001108350.1|      --------GVLDLPGQGAS-FVGAGAAFVVDIVVSVLVSMATRPKADTELVGLVYSLTPK
ref|YP_644805.1|         --------GTIQYGAPMAGNFWRAWWAWLVCFVVTIAVSLVTRPKEERELRGLVYGLT--
ref|YP_589403.1|         DPSALRYVAMSPDAQAMAENMYRALWSCLICALVTVVVSYATKPRPDAELVGLVKSVT--
ref|YP_822512.1|         DHTAIQYVAMSPNAKDMAENMFRALWSWLVCVIVTVVVSLMTKPKPEKELVNLVYGCT--
RAAC00662                -----AHMFSSPDAG----NFWRAWWAWVITVVVTVLVSLVTQGKRPEELEGLVYGLS--
                                   :    *   :      ::: **  *   :    ** .** . :

ref|YP_825097.1|         ----ELKHDEGVSWYLRPVPLAIAIGALALFLN--FW
ref|YP_001108350.1|      ESRTASTSGEDAGWYRRPGLLAGIVLVITVLLNIIF-
ref|YP_644805.1|         ----EKKEGVEQAWYKKPGVLAAAVLLITLVLNVIFF
ref|YP_589403.1|         ----PIPSEGDVPMYMRPAFWACVVAVGFIILQIIFW
ref|YP_822512.1|         ----DIPSEGHLPVWQRPAFWACVVGAVFIALNIIFW
RAAC00662                ----KRPDYSGYPWYKRPGYLAAIVFVILVGLNIAFW
                         :  :*    *     :  :  *:   *
```

FIG. 8

```
emb|CAE45698.1|      MARVLLEHIYKTYPGQTEPTVKDFNLDIQDKEFTVFVGPSGCGKTTTLRMIAGLEDITEG
RAAC00732            MARVLLEHIYKTYPGQTEPTVKDFNLDIQDKEFTVFVGPSGCGKTTTLRMIAGLEDITEG
ref|NP_623554.1|     MAEVVLKHVYKVYPGGVT-AVKDFNLEIADKEFIVLVGPSGCGKTTTLRMIAGLEEITSG
ref|YP_001664561.1|  MADVVLKHVYKVYPGGVT-AVKDFNLEIQDKEFIVLVGPSGCGKTTTLRMIAGLEEISSG
ref|YP_001181115.1|  MASVRLKGVYKRYPGGVT-AVSDFNLDIEDKEFIVLVGPSGCGKTTTLRMIAGLEEVTEG
ref|ZP_02329051.1|   MAGVRLNHIVKKYPGNDEATVKDFHLEIKDKEFLVLVGASGCGKSTTLRMVAGLEEITEG
                     ** * *: : * ***       :*.**:*:* **** *:.*:***::: * emb|CAE45698.1|      NLYIGDRRVNDVPPKDRDIAMVFQNYALYPHMTVYQNMAFGLKLRKVPKAEIDRRVQEAA
RAAC00732            NLYIGDRRVNDVPPKDRDIAMVFQNYALYPHMTVYQNMAFGLKLRKVPKAEIDRRVQEAA
ref|NP_623554.1|     ELYIDGKLVNDVPPKDRDIAMVFQNYALYPHMTVYDNMAFGLKLRKVPRAEIDRKVKEAA
ref|YP_001664561.1|  ELYIDGKLVNDVPPKDRDIAMVFQNYALYPHMTVYDNMAFGLKLRKVPRAEIDRKVKEAA
ref|YP_001181115.1|  EIYIGDKLVNDVPPKDRDIAMVFQNYALYPHMTVFENMAFGLKLRKFPKDEIKRRVHEAA
ref|ZP_02329051.1|   ELYIGDRLVNDVAPKDRDIAMVFQSYALYPHMNVYQNMAFGLKLRKFKKADIDTRVREAA
                     :;..: .*******.****.*::**********.  : :*. :*:*** emb|CAE45698.1|      KILDIAHLLDRKPKALSGGQRQRVALGRAIVREPQVFLMDEPLSNLDAKLRVQMRAEIRK
RAAC00732            KILDIAHLLDRKPKALSGGQRQRVALGRAIVREPQVFLMDEPLSNLDAKLRVQMRAEIRK
ref|NP_623554.1|     RILGLEELLNRKPKALSGGQRQRVALGRAIVRNPKVFLMDEPLSNLDAKLRVQMRTELKK
ref|YP_001664561.1|  RILGLEEYLNRKPKALSGGQRQRVALGRAIVRNPKVFLMDEPLSNLDAKLRVQMRTELAK
ref|YP_001181115.1|  KILGIEHLLDRKPKALSGGQRQRVALGRAIVREPKVFLMDEPLSNLDAKLRVQMRTELSK
ref|ZP_02329051.1|   KLLEIEHLLDRKPKALSGGQRQRVALGRAIVREPQVFLMDEPLSNLDAKLRVQMRAVISK
                     ::* :  . *:*****************:*:******************: : * emb|CAE45698.1|      LHQRLQTTVIYVTHDQTEAMTMGDRIVVMRDGVIQQADTPQVVYSQPKNMFVAGFIGSPA
RAAC00732            LHQRLQTTVIYVTHDQTEAMTMGDRIVVMRDGVIQQADTPQVVYSQPKNMFVAGFIGSPA
ref|NP_623554.1|     LHERLQTTFIYVTHDQTEAMTMGTRIVVMKDGVIQQVDEPQVIYDYPNNLFVAGFIGSPQ
ref|YP_001664561.1|  LHDRLQTTFIYVTHDQTEAMTMGTRIVVMKDGVIQQVDKPQTIYDYPNNLFVAGFIGSPQ
ref|YP_001181115.1|  LHKRLGTTFIYVTHDQTEAMTMGTRIVVMKDGFIQQVDTPQVLYEQPANLFVAGFIGSPQ
ref|ZP_02329051.1|   LVKRLETTCIYVTHDQTEAMTMGDRIVVMDKGVIQQAASPKEIYNFPVNMFVAGFIGSPS
                     * .  ************* ***  .*.***.  *: :*. * *:******** emb|CAE45698.1|      MNFIRGEIVQDGDAFYFRAPSISLRLPEGRYGVLKASGAIGKPVVLGVRPEDLHDEEVFM
RAAC00732            MNFIRGEIVQDGDAFYFRAPSISLRLPEGRYGVLKASGAIGKPVVLGVRPEDLHDEEVFM
ref|NP_623554.1|     MNFIDARLENRDGKVYATFKGYSILVPEGILKRLKDPSYIGKEIVLGIRPEDLHDEEVFL
ref|YP_001664561.1|  MNFIDARLENKNGKVYATFKGFSILVPEGILKRLKDPSYVGKEIVLGIRPEDLHDEEVFL
ref|YP_001181115.1|  MNFIESRIEQKDKNLYVVFGNNAIKLPEGKAKKVEELGYVGKEVIMGIRPEDLHDEEIFL
ref|ZP_02329051.1|   MNFVDGAISEENDELLFKAPGVNIVIPEGKAKLLREKGYTNKEVVLGIRPEDLHEEPVFL
                     ***: . : . .       . : :***     :. .   .* :::*:*******:* :*:

emb|CAE45698.1|      TTYPDSVLQMQVEVVEHMGSEVYLHTS-IGPNTIVARVNPRHVYHVGSSVKLAIDLNKIH
RAAC00732            TTYPDSVLQMQVEVVEHMGSEVYLHTS-IGPNTIVARVNPRHVYHVGSSVKLAIDLNKIH
ref|NP_623554.1|     EAYPEAVVEAKVEVTELMGAETYLYLD-VNGVSLTARVDPRTRAKSGDVIKIGFDVNKLH
ref|YP_001664561.1|  EAYPEAVVEAKVDVTELMGPETYLYLD-VNGVPLTARVDPRTRAKAGDVIKIGFDINKLH
ref|YP_001181115.1|  QTAQDAVVVDAHVDVVEMLGSETLLYVV-VDGLNLIARVDPRSKTKAGDKIKLAFDANRIH
ref|ZP_02329051.1|   EASPNSIVSANIEVAENLGHEMNLYINGIGTSSVIARVDGRSGLKEGSTVKLALDMNKVH
                      :  :::::. :::*.* :* *  *:    :.   : *** *   : *. :*:.:* *::* emb|CAE45698.1|      IFDAETEESIGFAAGPAGERQEALV
RAAC00732            IFDAETEESIGFAAGPAGERQEALV
ref|NP_623554.1|     MFDKETEMTI---------------
ref|YP_001664561.1|  MFDKETEMSI---------------
ref|YP_001181115.1|  LFDKETEKAI---------------
ref|ZP_02329051.1|   FFDKETTESI---------------
                     :** ** :*
```

FIG. 9A

```
ref|YP_145275.1|       --------------------AYALGGLGLTLPAQTFGTYLAFYYLDRLGMPAGAFALA
ref|YP_006204.1|       --------------------AYALGGLGLTLPAQTFGTYLAFYYLDRLGMPTGAFALA
ref|NP_623507.1|       --------------------KKVAYSFGNFPIGIMLEAFGTYVMFFYIDVLKVDPSFISLA
ref|YP_001469682.1|    --------------------KNFLYSLGSFSSALFSNAISTFAIFYYVDVLKAPPHLISII
RAAC00804              MSMAQVGLHPSVRPRPSAAKKTAYAANQIAVNMLWQAFNAVAVYDYVAYHGVSAVRLSSG
ref|YP_001432292.1|    --------------------AYSMGNFANTIAYQVFGNRIQFYYVDVLGLNAAAAGVI
                                           *: . :  :  :..:.  : *:    . .

ref|YP_145275.1|       RLIFSVWDAVNDPLFGYLSDRTRTPWGRRRPWLFL-SLPFLLLAFYLAFSVPEAFRKGTR
ref|YP_006204.1|       RLIFSVWDAVNDPLFGYLSDRTRTPWGRRRPWLFL-SLPFLLLAFYLAFSVPEAFREGTR
ref|NP_623507.1|       FVIHGIIFAIFNPLIGYVSDKTETRWGRRRPYIAFGIVPLA-LVFYVIWSP-FVS--KEF
ref|YP_001469682.1|    MVLYGIWNAINDPLFGYLSDTTKTRWGRRKPYIVWFSLPLT-ISFAMFWAPPFDSSQKTA
RAAC00804              LIVYGVLNALFNLVAGHVSDRTKTRFGRRIPYVAVASIPYA-VCFALLFSPPPHLS--QTG
ref|YP_001432292.1|    WTIYGLWNAINDPLMGQLSDRTRTPMGRRVPYVLFGAVPLG-LSFFFLWTPPGQS--PWL
                       :..: *: : : *:** *.* *** *::    :*    : * . ::

ref|YP_145275.1|       LFWYGLWAMLLFETFSALAWVNHAALFPELFQSREERARANAWRQGFYFLGLTASIALTP
ref|YP_006204.1|       LFWYGLWAMLLFETFSALAWVNHAALFPELFQSREERARANAWRQGFYFLGLTASIALTP
ref|NP_623507.1|       LPAYFLTVIILFDFLYVLVGLNLAALFPEMFPSLEERAQVSAYRQMFGILGSIIGVVLPP
ref|YP_001469682.1|    LVIYYLIMIFLFDTFFTIVFLNWTALFPEMYPTLKERAKISGLRQILAIPGLLLGVAVTP
RAAC00804              LVVYFLAMTFLFDLAFTFTALNANALYPEMYPDPRDRAYVSALQQVFGIVGLIAGVALSK
ref|YP_001432292.1|    LAAYFLIILFIFDTLYSLTIIAYNALFPEVAPHLKARIDLSAVREVLATIALLLSFILAP
                       *  *    ::*:      :. .:   **:**:      .*   ..  ::      .. :.

ref|YP_145275.1|       LVYAALGFPGMALLYGAVGGGLVLLFLLSVRE--DPRAREAEPLPFVPAFRYTLGNRAFW
ref|YP_006204.1|       LVYAALGFPGMALLYGAVGGGLVLLFLLSVRE--DPRAREAEPLPFVPAFRYTLGNRAFW
ref|NP_623507.1|       IIYSRYGWNVLGIIFGTLIAIGFFIAFYGCEE--KKNIKIPSIPVL--TAFKYVFLNKAFL
ref|YP_001469682.1|    VIAAKIGWGKMGAVFVLVIGGSILYMTLFGIKE-NPEFSHQQTLNII-EAIKFTFFNRSFF
RAAC00804              SLGQALGWSRMAWIFAAVAVASMYVSLWGSFE-TG---DPAEPFAWREALRETFRNRAFI
ref|YP_001432292.1|    ILAEGVGYIWMGAIMGTLVAVGYLISMAGVRE--DISKIKDDRFGLIESLRIALSSRPFR
                       :    *:   :. :  ..:    : :.  *          :::  .:  .:.* ref|YP_145275.1|       IYALAALFLLFAVGLFAAAMPFYAKHALGLG------------EEATALLFASVLLAALP
ref|YP_006204.1|       IYALAALFLLFAVGLFAAAMPFYAKYALGLG------------EEATALLFASVLLAALP
ref|NP_623507.1|       PFVVGGFFAKFLLTSVPAAIPFFTKYVLRIP------------EKEVSLLLGSIFVTAIP
ref|YP_001469682.1|    TYVVPSFLLQFTYTMLTATLPFYAKYVLKAS------------ETQTTLLLASIFVVAFF
RAAC00804              WYVIASFLVQFTTTLFTTASSFYTSYVVRLS------------PLQNSLFLGGIFVVAMP
ref|YP_001432292.1|    WFIGANIAKEYIWLVLAAMLPFWRKYALGIQGQTEVFGMRLSGGDAEAILLGVPILLTIP
                       :   :    :    ..:  .*: .:.:                :::: .  :: ::

ref|YP_145275.1|       SVSLWARLAGALGPKRAWLWAIGLLALGALLLLWPRGLLEALP--VGVLIGTGFGGVLVL
ref|YP_006204.1|       SVSLWARLAGALGPKRAWLWAIGLLALGALLLLWPRGLLEALP--VGVLIGTGFGGVLVL
ref|NP_623507.1|       MMLVWSKITKKFGSRKAMFLSIGFLILVFPAYFFVNTFVETLI--VSVIFGALLAGVVML
ref|YP_001469682.1|    LIPVWQKITAKIGAKKTMKVSMILWAILLIGFGFVKTFFQAII--LTSALAMSLAGALIV
RAAC00804              IAFVWARAAIRYGASRSAMVAIALYACVEALLLVDRSPTSVLV--TGLCLGVPVAGFMVL
ref|YP_001432292.1|    MLLIWRPMVARIGPRRSWIITSFCFIPGFLAMILANDFYTGLI--GTLLVVPGLAGSMIM
                       :*   .  *. ::      :           .    :    ..* :::

ref|YP_145275.1|       GDVLLAEVIDRDAAATGRRREGVYYSVYGFINRLSGPLQALAFALLTPLFGYVSGENP--
ref|YP_006204.1|       GDVLLAEVIDRDAAATGRRREGVYYSVYGFVNRLSGPLQALAFALLTPLFGYVSGENP--
ref|NP_623507.1|       LDVMLAEVIDEDTKNTGMKREGMYTGVFGFIIRFGYSLQGIVIGGILKLSGYIPNVLE--
ref|YP_001469682.1|    FDIMIADISDEDEIKTGKRREGMYFGANALIIRLGISLNSLIMGFVLSSSGYDANLPAEM
RAAC00804              LNMLLAEVIDLDARRTGRRREGMYLGMNGCIVRLGLSLQYAVMAIFFAVSGYRAGASV--
ref|YP_001432292.1|    PFPLISEVIDDDAARHGYRREGIFFGINGGITKLAFSAQGVLFAAVLSLSGYVAGSDA--
                       :::::: * *   * :***::. . .:::.. . :..    ** ..
```

FIG. 9B

```
ref|YP_145275.1|      GP------------------------------------
ref|YP_006204.1|      GP------------------------------------
ref|NP_623507.1|      QPSSAI--------------------------------
ref|YP_001469682.1|   QPLTAV--------------------------------
RAAC00804             QPTSAVEGLRLLLGLVPALFLAGAFLCMRVYDRTRTR
ref|YP_001432292.1|   QPESA---------------------------------
                       *
```

FIG. 10A

```
ref|YP_001390862.1|   ------------------------------------------------------------
ref|YP_001254028.1|   ------------------------------------------------------------
ref|ZP_02128903.1|    ------------------------------------------------------------
ref|YP_001243927.1|   ------------------------------------------------------------
ref|NP_228405.1|      ------------------------------------------------------------
RAAC00824             -----------------------------------------------------------M ref|YP_001390862.1|   ----------------------------------------KEESKATIATEIKEPVTIEFWH
ref|YP_001254028.1|   ----------------------------------------KEESKATIATEIKEPVTIEFWH
ref|ZP_02128903.1|    ------------------------------------------------------VKVTFWH
ref|YP_001243927.1|   ------------------------------------------------------VKVTFWH
ref|NP_228405.1|      ------------------------------------------------------VKVTFWH
RAAC00824             KHKNKALMATATAVVMCAWMATGCGDEETGGGGGIPMTKSSNASGQAASTAQPVTITFEE
                                                                            *.: * .

ref|YP_001390862.1|   AMSGDNEAALKEITEEFNKKNKDKITVKLVYQGQYKELFSKLDGAAKSKKLPALTMIYPN
ref|YP_001254028.1|   AMNGDNEAALKEITEEFNKKNKDKITVKLVYQGQYKELFSKLDGAAKSKKLPALTMIYPN
ref|ZP_02128903.1|    AMGGGHGETLQEIVNTFNELHPD-IEVEAVYVGNYSALSQKLLAAAQAGELPTISQSYSN
ref|YP_001243927.1|   AMGGGHGKTLQEIVNTFNELHPD-IEVEAVYVGNYGALSQKLLAAAQAGELPTIAQSYSN
ref|NP_228405.1|      AMGGGHGKTLQEIVNTFNELHPD-IEVEAVYVGNYGALSQKLLAAAQAGELPTISQAYSN
RAAC00824             SMPGKLGTELQKLTNEFEKQNPN-IHVQLIFNGSYSTLEQKLTAAIASGTEPTVAQVEET
                      :*  *    *:::.: *:: : * *: :: *.*  *  .** .*  :   *:::    .

ref|YP_001390862.1|   RLTAYVMNDLVENLNPYIENEKIGFKKDVWDDIPEFVRDNGMWNDKHYSLPFNKGTYLLF
ref|YP_001254028.1|   RLTAYVMNDLVENLNPYIENEKIGFKKDVWDDIPEFVRDNGMWNDKHYSLPFNKGTYLLF
ref|ZP_02128903.1|    WTAKLIQSGVVQPLNEFVNDPKIGLTKEEWEDIFKPLRDNCMWGDTIYAVPFNKSLYILY
ref|YP_001243927.1|   WTAKLIQSGVVQPLNEFVNDPKIGLTREEWEDVFKPLRDNCMWGDTVYAVPFNKSLYILY
ref|NP_228405.1|      WTAKLIQSGVVQPLNEFVNDPKIGLTKEEWEDIFKPLRDNCMWGDTIYAVPFNKSLYVLY
RAAC00824             WETNYVQNGLIEPLDSVIP-------KSTQNDLIPIWRQDSTYNGKLMSVPFNKSAYVLY
                       :  :  ..::: *:  :        :.  :*:   *::  :..  ::****. *:*:

ref|YP_001390862.1|   YNEDLLKKYNVKVP-NNWNELKEASKKLTVDTNGDGKNDIYGLGLNSSVGIDSSFWVEQA
ref|YP_001254028.1|   YNEDLLKKYNVKVP-NNWNELKEASKKLTVDTNGDGKNDIYGLGLNSSVGIDSSFWVEQA
ref|ZP_02128903.1|    YNADAFAMYGVDVP-KTIDELYEAARIMTEDLDGDGNIDQYGFGFRTTVDFFQILLLLRG
ref|YP_001243927.1|   YNADAFAMYGVDVP-KTIDELYEAARIMTEDLDGDGKIDQYGFGFRTTVDFFQILLILRG
ref|NP_228405.1|      YNADAFAMYGVDVP-KTIDELYEAARIMTEDFDGDGKIDQYGFGFRTTVDFFQILLTLRG
RAAC00824             YNVDDLKKAGISSPPTTWSQLEQDAIKIQK------KEGIPGLGLQGNYYTFEMLLKQAG
                      ** *  :    .:. *  ..  :* ::  :        :  *:*:.     . :     .
```

FIG. 10B

```
ref|YP_001390862.1|    GGHLIDEANDKLLFNS--KEGVEAFDFLSELVKSGNAKISTEEKYMTGAFSRGEAAMGIS
ref|YP_001254028.1|    GGHLIDEANDKLLFNS--KEGAEAFDFLSELVKSGNAKISTEEKYMTGAFSRGEAAMGIS
ref|ZP_02128903.1|     G-SILKQVDGKWVSNIDSQETRDVLAFVKKMVDDGIAYFQGG--YLNDIFGQQKIMMYID
ref|YP_001243927.1|    G-SILKQVDGKWVSNIDSQETREVLAFVKKMVDDGIAYFQGG--YLNDIFGQQKIMMYID
ref|NP_228405.1|       G-SILKQVDGKWVSNIDSQETRDVLAFVKKMVDDGIAYSQGG--YLDGIFGQQKIMMYIS
RAAC00824              G-QILNARNTKAAFDS--SAGLAALHFMKRLVDEHAAKVIGANEYLSDGFNTNEYAMDLD
                       *   ::.   :  *    :       .   .: *:..:*..  *         *: . *.   :  * :.

ref|YP_001390862.1|    SISALPDIIKACKGNNINFKTAVLPEGKKKAALFSGTDVAIFNTPSPEEKLAAFEYLKFF
ref|YP_001254028.1|    SISALPDIIKACKGNNINFKTAVLPEGKKKAALFSGTDVAIFNTPSPEEKLAAFEYLKFF
ref|ZP_02128903.1|     TIAGRPYVESSTKG-KFTWSWAPVPTWVTNKVPFAGTDIIMFNTASDEEKRAAWEFMKYL
ref|YP_001243927.1|    TIAGRPYVESSTKG-KFTWSWAPVPTWVTNKVPFAGTDIIMFNTASDEEKRAAWEFMKYL
ref|NP_228405.1|       TIAGRPYVEKSTKG-KFTWSWAPVPTWVTNKVPFAGTDIIMFNTASEEEKKAAWEFMKYL
RAAC00824              TVAAMSFINN----SNLHWKVAPLPKGVTYAVPTAGLNLVIFNAATSAQKAAAAKYLNFL
                       :::. . :   ::  :.  * :*     .    .    :*  ::  :**:.:  :* **  :::::

ref|YP_001390862.1|    MEKESQTRWATKSGYLPLRKSVIDSKEFKDYVEKENPAKGEAVKEFDYGYCDPKVLNGY-
ref|YP_001254028.1|    MEKESQTKWATKSGYLPLRKSVIDSKEFKDYVEKENPAKGEAVKEFDYGYCDPKVLNGY-
ref|ZP_02128903.1|     ISPEVTAYWAINTGYIPVRRSALETSIWKEAAKSD-PLIEIPLKQIDNAMFDPQIGVWY-
ref|YP_001243927.1|    ISPEVTAYWAINTGYIPVRRSALETSIWKEAAKSD-PLIEIPLKQIDNAVFDPQIGVWY-
ref|NP_228405.1|       ISPEVTAYWAINTGYIPVRRSALETSIWKEAAKSD-PLLEIPLKQIDNAVFDPQIGVWY-
RAAC00824              ISVPSTIEWAEQTGYLPVRQSALTNSAWTSFIKTH-PNQGVAPNELKYAYFSPRLASLYS
                       :.        :::*:*:*.:  ..  :..    :..  *    .  :::. .  .*::    * ref|YP_001390862.1|    ---AIHDNMAKALDQIIAGKKDSKQALSDAEKKARQEL-
ref|YP_001254028.1|    ---AIHDNMAKALDQIIAGKKDSKQALSDAEKKARQEL-
ref|ZP_02128903.1|     ---EIRTVVGNMFSDFINGKVDMETAIKTADQKIRE---
ref|YP_001243927.1|    ---EIRTVVGNMFSDFINGKVDMETAIKTADQKIRE---
ref|NP_228405.1|       ---EIRTVVGNMFSDFINGKVDMETAIKTADQKIRE---
RAAC00824              AEQEMTTQIGNMLAGRQTPQVTLQNMANITNQALAQGNS
                          :    :.:  :      :     :      . :::    :
```

FIG. 11A

```
ref|NP_391276.1|         --------------SMGFVILISCAAGLGGLLYGYDTAVISGAIGFLKDLYS----LSPFM
ref|YP_001422694.1|      ----------------FVILISCAAGLGGLLYGYDTAVISGAIGFLKDLYR----LSPFM
ref|NP_347967.1|         ----------HKHSLLFIVLISCAAGLGGLLYGYDTAVISGAIGFLKKLYN----LSPAM
ref|YP_804553.1|         ----------------YVILISCAAALGGLLFGYDTAVISGAVGFLQIKFT----LSSAQ
RAAC01073                MMQAEVAQAEYRPNLGYVVTVVVIASLGGLLFGYDTGVIAGANEFLKSEFH----MSAAT
ref|NP_978526.1|         ----------------YIFSITLVAAIGGLLFGYDTAVISGAEESLKVYFIDSLGLGSLA
                                         ::.  :    *.:****:****.**:**   *: :      :..

ref|NP_391276.1|         EGLVISSIMIGGVVGVGISGFLSDRFGRRKILMTAALLFAISAIVSAL---------SQD
ref|YP_001422694.1|      EGLVISSIMIGGVFGVGISGFLSDRFGRRKILMAAALLFAVSAVVSAL---------SQS
ref|NP_347967.1|         QGFVISSIMVGGVLGVGFSGFLGDAIGRRKVLMLAAALFAISAVISSI---------STS
ref|YP_804553.1|         VGWVTSCILIGCALGVSIAGILSDLFGRKKILALSAVIFALSSLGAAF---------AGS
RAAC01073                TGLVSSSIDLGAMLGVLIAGFLGDSFGRKKALSVAGIIFIASSLISAF---------APS
ref|NP_978526.1|         HGVTVSSALIGCIIGGVISGYCASKFGRKRSLIIAAILFIVSALGASYPEFLFFTKGEPT
                          *  . *. :*  .*    ::*   .. :**::  *    :. :*  *::  ::

ref|NP_391276.1|         VSTLIIA---RIIGGLGIGMGSSLSVTYITEAAPPAIRGSLSSLYQLFTILGISATYFIN
ref|YP_001422694.1|      VSSLVIA---RVIGGLGIGMGSSLSVTYITEAAPPAIRGSLSSLYQLFTILGISGTYFIN
ref|NP_347967.1|         AFMLIFA---RIVGGLGIGMGASALSVTYITECAPPSIRGRLSSLYQLFTILGISITFFVN
ref|YP_804553.1|         YMILVIW---RMLAGIGIGLTSLITPLYIAEMAPSNVRGKLVSVNQLAITIGIFIVYFVN
RAAC01073                VGVLVLG---RFIGGVGIGLASLLSPLYIAEIAPPRIRGRLVGSNQLAIVSGIFIVYFVN
ref|NP_978526.1|         IVLLLAFNLYRIIGGIGVGLASAICPIYIGEIAPADIRGRLVSFNQFMIIFGMLVVYFVN
                                *:      *.:.*:*:*: * :   ** * . :  *  .  *:     *:   ..*:.* ref|NP_391276.1|         LAVQRSGTYEWGVHTGWRWMLAYGMVPSVIFFLVLLVVPESPRWLAKAGKTNEALKILTR
ref|YP_001422694.1|      LAVQQSGSYEWGVHTGWRWMLAYGMIPSVIFFIVLLIVPESPRWLAKAGRRNEALAVLTR
ref|NP_347967.1|         LGIVNMGSETWRVSTGWRYMLACGTVPAIVFLITLFFVPESPRFLVKSGNIKKAAAVLTK
ref|YP_804553.1|         AAIASNATQLWNVSTGWRWMMGVGVIPSLLFLIALIPAGESPRYLSQHGKSEAAYKVLQK
RAAC01073                AAIVSSHTTAWNQTTGWRWMFAMGVIPAVIFFFLLFLVPESPRYLMKRGREEQAISILER
ref|NP_978526.1|         WGIANGETLEWINDVGWRYMFASGVIPAIIFAILLLFVPETPRYLAIQHQDKKALAILTK
                          .:      :   * .***:*:.   * :*::*:* : :*: . *:**:*    . : :* :

ref|NP_391276.1|         IN-GETVAKEELKNIENSLKIEQMGSLSQLFKPGLRKALVIGILLALFNQVIGMNAITYY
ref|YP_001422694.1|      IN-GEQTAKEEIKQIETSLQLEKMGSLSQLFKPGLRKALVIGILLALFNQVIGMNAITYY
ref|NP_347967.1|         IN-GAEIAKQELDSISKSLATENDSSLGQLLQPGLRRALLIGIFLAIFNQAIGMNSITYY
ref|YP_804553.1|         VEISDEAAEKSLEEIQNEVVDDTKFRDLFNKTWLPVLIIGVLLAFQQQFSGSNAIMYY
RAAC01073                VS-GPERARWDVEEIRKSLEVVPDSLFQELSRPGIRKALGIGVVLAIFQQFTGTNAVGYY
ref|NP_978526.1|         IN-GPLEAKAILDDIKQTMAINVSS--EKLFSYG-KLVIIVGVLLSVFQQFVGINVALYY
                          :. .   *.   :..* :          .*     .:  :*:.*::*:* *   ** ref|NP_391276.1|         GPEIFKMMGFGQNAGFVTTCIVGVVEVIFTVIAVLLIDKVGRKKLMSIGSAFMAIFMILI
ref|YP_001422694.1|      GPEIFKMMGFGQNAGFITTCIVGVVEVIFTIIAVLLVDKVGRKKLMGVGSAFMALFMILI
ref|NP_347967.1|         GPEIFQMIGFKNNSSFLATSVIGVVEVFSTILAMFLIDKLGRKKLMEIGSAAMAVFMLLI
ref|YP_804553.1|         APEIFKGAGFGQSGAFMATVSIGVINMVITIVALGLVDKIGRKKLLGWGSFAMSCCLLVV
RAAC01073                APMIFKAAGAGTNASFYDTVWIGAIKVIFVIVLMLIVDRVGRKRLLVWNGMLMALFLAIL
ref|NP_978526.1|         APRIFESMGAAKDSSMMQTIIMGLVNVIFTVIAILTVDRWGRKPLLIVGSIGMA--IGMF
                          .* **:  *    ..:  *  *  ::: .::   :*: *** *:    *:   : :.

ref|NP_391276.1|         GTS-FYFELTSGIMMIVLILGFVAAFCVSVGPITWIMISEIFPNHLRARAAGIATIFLWG
ref|YP_001422694.1|      GAS-FYFQLASGPALVVIILGFVAAFCVSVGPITWIMISEIFPNHLRARAAGIATIFLWG
ref|NP_347967.1|         GTS-FYIKLSNGFVILIFIICFVVSFCISMGPIPWIMIPEIFPNHLRARATGIATIFLWG
ref|YP_804553.1|         SIC-FFV-HAATSITLTFVLLAIAAYAVSLAPVTWILISEIFPLKIRGRAMSICTAVLWL
RAAC01073                GVA-FSLPHMITWLVLALVFAHTIAYELSWGGGVWIVLSEIYPTAIRGRAMAIASFALWF
ref|NP_978526.1|         GVASMAFANIIGIGTLIFIIVYTASFMMSWGPICWVLISEIFPNKIRGQAVAIAVAAQWA
                         . . : .         :  ::   ::  :*  .  *:::.**:* :*.* .*.     *
```

FIG. 11B

```
ref|NP_391276.1|         ANWAIGQFVPMMIDSFGLAYTFWIFAVINILCFLFVVTICPETKNKSLEEIEKLWIK---
ref|YP_001422694.1|      ANWAIGQFVPMMISGLGLAYTFWIFAVINILCFLFVVTICPETKNKSLEEIEKLWIK---
ref|NP_347967.1|         ANWAIGQFTPMLLNGIGGAYTFWIFCGINVICFLVVTTKVPETKNKSLEEIEKFWIPKSK
ref|YP_804553.1|         SDFTLSYTFPILTQNIGEGWTFMLYVVVTALSAIFVWKLVPETRGKSLEEIEVYW-----
RAAC01073                ATYLVAQFFPILLQAIGGTWTFWIFALFCIAMAVFMQRVVPETSKKTMEKIQSDWLQSER
ref|NP_978526.1|         ANYFISSTYPMMMEYSGGL-TYSFYGLMSVLSALFVWKLVPETKGKTLEQMENTW-----
                          : :  :.   *::  .  *    *: ::  .       :.:    ***  *::*:::   * ref|NP_391276.1|         --------
ref|YP_001422694.1|      --------
ref|NP_347967.1|         QNAKGSSV
ref|YP_804553.1|         --------
RAAC01073                GSSL----
ref|NP_978526.1|         --------
```

FIG. 12A

```
gb|ABP57783.1|      ------------------------------------------------VTITFWHGM
RAAC01120           MEAKPMKRDRLWKSGALLALGLVATGCGAPAANGGGQAATGASRAAASSQPVTITFWYGV
ref|YP_001089934.1| ------------------------------------------------IDFWAPL
ref|ZP_01801573.1|  ------------------------------------------------IDFWAPL
ref|ZP_01173000.1|  ------------------------------------------------IHIKYWYAW
ref|YP_076008.1|    ------------------------------------------------VKVTFWHAM
                                                                    : :* gb|ABP57783.1|      NGPYQKALDQIINDFNKSQKQYKV---VGTAQGNYTALQQ---KIMAAAKSRNLPTIAQT
RAAC01120           GTTLSQDIQQMVQAFNQTHPGIKV---VATYQGSYSGGGEEQQKLLAAIKAGDPPTIAQI
ref|YP_001089934.1| GGTNGETAQKMVDQFNSEHKDVQV---NMLKQKDYYENAT---KLQAALTSKDQPDVTLL
ref|ZP_01801573.1|  GGTNGETAQKMVDQFNSEHKDVQV---NMLKQKDYYENAT---KLQAALTSKDQPDVTLL
ref|ZP_01173000.1|  GDKIGENNENLVKMFNESQDKIYV---EAEYQGTYDELHS---KTQAAFAAKNAPEVTQN
ref|YP_076008.1|    GGVAGEAVQRLVDQFNSQDKVEV---EAVYQGTYDDALQ---KLRAA--GSDGPTIMQV
                      . : :.::.  **. :       *          *   *  **  . : * :

gb|ABP57783.1|      TYTTVPDYVKNGFISPLDQYMLKGDDKMSSSDLKDIYPAFLSSSKYQGKYYSVPFSKSTR
RAAC01120           EVHAMPVFAASGQLLDLTNLMQSS----SVDKPSNFLPGILVSTQYQGRYYAVPFNRSVP
ref|YP_001089934.1| EITQTGTFASAGALVDMSKYFDKTY--QER-----FFSGLLTNSYYEDKFVGMPFNRSTP
ref|ZP_01801573.1|  EITQTGTFASAGALVDMSKYFDKTY--QER-----FFSGLLTNSYYEDKFVGMPFNRSTP
ref|ZP_01173000.1|  EIASIGVFAKSGMTQDLTPFVEKDD--INM---DDFNPGLMGNSYVDDKLYGLPYLRSTP
ref|YP_076008.1|    YEIGSRFMIDSGMITPMQNFVDADG--FSID---DFEPNILGYYTFDGRLYSMPFNTSTP
                          *    :   .        .  ::      ::      :.:*:  *.

gb|ABP57783.1|      ILFYNEALMKKY--NIAKPTS-WEDIK---KDADKLK--ADGIAAIGFDKSFDM-EFEGL
RAAC01120           VLYYNKTLFAKA--HIASPPSNWAQLA---ADAKKLTSGAGSNKIYGFEPLVDWWPWEYA
ref|YP_001089934.1| ILYINKDMATKAGLDPSGP-KSWEELK---DYASKMTNK--SEDTYGFETPIDIWFYEAM
ref|ZP_01801573.1|  ILYINRDMATKAGLDPSGP-KSWEELK---DYASKMTNK--SEDTYGFETPIDIWFYEAM
ref|ZP_01173000.1|  ILYMNTTMLKEAGLDPAGP-KDWKEFE---EYLTALTKE---GKTVGMTMPVNIWMYEAF
ref|YP_076008.1|    IVYYNKDAFREAGLDPERPPRTFEEFK---EYARKLTVTQGGETRYGASIALYGWFFEQF
                    ::: *    :   .  *   :  ::      :.        *        .   :* gb|ABP57783.1|      ARQAGNPLVSADP------LKANLDSKKTLTAANFIMDMVNSGEAKTAGED--IYGD---
RAAC01120           VESGGGSILSPDL------KRATFDQPPALSILETEQSLVKQGYAKVETGP--NYWDLMT
ref|YP_001089934.1| VMQSGGEITNG--------KKVAFNNEAGQAPVKFWQDMMKAGIMKMPPGEDYNAWDVAK
ref|ZP_01801573.1|  VMQSGGEITNG--------KKVAFNNEAGQAPVKFWQDMMKAGIMKMPPGEDYNAWDVAK
ref|ZP_01173000.1|  VAQGEGQMISDDE------KSAEFNGEAGVEALEFWKKMADKGVIKVPGGE--AAAEVAK
ref|YP_076008.1|    LAVQGAHYVDNDNGRSARATKAIINSPEGERFVTWLKEMVDEGVA-INLGR--RTADTQA
                         .             . ::          .: .   *                :

gb|ABP57783.1|      KNFTAGKTLFYAGSSAGITN-MKQNAPKDFKWGTMPLPSYKG-KK-ATELAGNDIVLFKS
RAAC01120           QDFINGQVAMDIDSIGSAGK-VTKGVGDKFQWGTALLP--RG-KTLAVPPGGGDLAIFKD
ref|YP_001089934.1| QDFVNGKVGMIFTSTADLAG-LMQQTEGKFEISTAFLPKNQ---KYATPTGGANLVMLEG
ref|ZP_01801573.1|  QDFVNGKVGMIFTSTADLAG-LMQQTEGKFEISTAFLPKNQ---KYATPTGGANLVMLEG
ref|ZP_01173000.1|  QDFANSRSAMAFSSTADLSYNLSVAEEQGFELNTAFMPANK---VNGVPTGGANLVMTAG
ref|YP_076008.1|    A-FSSGQVAMTLDSTAALGN-ILNGVGDKFEIGTAFLPREGAAEGGVIIGGASLWITNT
                      *   .: :   *  .  :         *: .* :*   .    .. .* .: :

gb|ABP57783.1|      ASSDKQKGAWAFMKYLLSEKETSKWSQLTGYVPLRKSAVKSADFKKYLSANPTSQAAVDS
RAAC01120           ATPAQQKAAWTFIQWWTAPKQSVQWSTETGYLPVQKADLNDPVYQAYLEKHPQYRTAIEE
ref|YP_001089934.1| GTDKEKEASAEFIEWMTQTDKIVQFSSSTGYLPTTEDATNSEKLQTLYKEKPQYKVATDQ
ref|ZP_01801573.1|  GTDKEKEASAEFIEWMTQTDKIVQFSSSTGYLPTTEDATNSEKLQTLYKEKPQYKVATDQ
ref|ZP_01173000.1|  LDEERQNAAWEFIKWMTAKEQTIYASEYTGYLPSRLSAVDSEEMKSLYEKMPQFKVAVDQ
ref|YP_076008.1|    KPLKEQWAAWEFVKWLTTPEVQAEWSIATGYFPVRKAAYDQQILKDWHAQRPQFTTAIEQ
                     .: .: *:::  .    * ***.*    ..  :    *   .* .* ::
```

FIG. 12B

```
gb|ABP57783.1|        LGFGFQSTA---------------------------------------
RAAC01120             LQYEHPSPASPAYLAVLQPVQQALQGIFDEGKPVAATMHQAAEAADQNLG
ref|YP_001089934.1|   LQYAVALPMLNGY------------------------------------
ref|ZP_01801573.1|    LQYAVALPMLNGY------------------------------------
ref|ZP_01173000.1|    LQYGHARPMAEAYPEVAKILTDQISRVMLEDGLAPKDALDEAAEKANQLL
ref|YP_076008.1|      LR-----------------------------------------------
                      *
```

FIG. 13

```
ref|YP_321082.1|          --------------------------------------------------Y
ref|NP_484832.1|          --------------------------------------------------Y
ref|ZP_01631485.1|        --------------------------------------------------Y
RAAC01122                 MAKAAEAVIAQVEGERRSARGSMSLQITGLAMMAPALLFLLAFVFVPMGY
gb|AAD33665.1|AF135398_2  --------------------------------------------------Y
ref|YP_001527659.1|       --------------------------------------------------Y
                                                                            * ref|YP_321082.1|          LFYLSFTAGSFTSTGTYWVGFKNYWRLLLNPDFWQVIGNTVYFTVASVIP
ref|NP_484832.1|          LFYLSFTAGSFTSTGTYWVGFKNYWRLLLNPDFWQVIGNTVYFTVASVIP
ref|ZP_01631485.1|        LFYLSFTAGSFTSSGTTWVGLRNYWRLLLTPDFWQVLGNTIYFTVATVIP
RAAC01122                 AVYLSLYQSTLYTPQPVFAGFANYAHLLAAPDFWQAASNTLWLAVGMMAL
gb|AAD33665.1|AF135398_2  SLYLSFLNTRVY-PWRLEVG-VNWGRLLQDPFFWTALKNTLFILLVQVPL
ref|YP_001527659.1|       SLYLSFFEWNGFTPNRDWVGGGNYARLLTSPEFWNSLKVTALYAGGVTLT
                           .***:            .*  *:  :**   *  **          * ref|YP_321082.1|          SLVIPLGLAVLLNRSMALRGVLRSAYFLPSIISLVAAGLGFRWLFQTSG-
ref|NP_484832.1|          SLVIPLGLAVLLNRSMALRGVLRSAYFLPSIISLVAAGLGFRWLFQTSG-
ref|ZP_01631485.1|        SLVIPLALAVLLDKSLALRGLLRSAYFLPSIISLVAAGLGFRWLFQTDG-
RAAC01122                 SLPVALVLALLLNQRIRGRALFRAAVFGPYVIPLVSSGLIFSLLFATDGG
gb|AAD33665.1|AF135398_2  MLALALLALALNSALLRAKGFFRFAFFAPVVVGAVAYSAVFRLLFNTEFG
ref|YP_001527659.1|       SLALGLLVAVLLNQPIRGRTFYRVLYFLPVITPTVAAGVVWKYLFDPTQG
                           *  *    *  .   :  . *   *  *   *:    :   **  .

ref|YP_321082.1|          PVNAFLNIFGIPAISWLGDTFWAMPVLIILSIWKQLGFNMVVFLAGLQAI
ref|NP_484832.1|          PVNAFLNIFGIPAISWLGDTFWAMPVLIILSIWKQLGFNMVVFLAGLQAI
ref|ZP_01631485.1|        PANAFLDFFGIAPIPWLGSTTWAMPVLIVLSIWKQLGFNMVVFLAGLQAI
RAAC01122                 PVNLALQRLGLSPVNWLGQGRTALLSVLILTAWQFTGYYAIIFLAGLQSV
gb|AAD33665.1|AF135398_2  AVNALLRTLGHPGYDWLYAPGPAMAVIIIALTWRWTGYNAIILLAGLQSI
ref|YP_001527659.1|       AVNSLLGSVGLHGPNWLVDPKWALLAVIIVGVWKRVGFNVVVYLAALQGV
                           .*    *  .*       **     *:  :::   *:   *:   :: **.**.:

ref|YP_321082.1|          PPSRYEAAELDGANGWRQFWHITLPGLRPTLIFATVTTAIFTLRSFEQVY
ref|NP_484832.1|          PPSRYEAAELDGANGWRQFWHITLPGLRPTLIFATVTTAIFTLRSFEQVY
ref|ZP_01631485.1|        PPSRYEAAELDGANAWQQFWHVTLPGLQPTMIFATVTTAIFTLRSFEQVY
RAAC01122                 PTSLMEACQVDGGGRWQVFRHVTLRALGPSLFFAVVICLIQTFQTFDQVY
gb|AAD33665.1|AF135398_2  PKELYEAAALDGAGPWQRFWHVTLPGIRPVLLFALILSIIGTLQLFTEPF
ref|YP_001527659.1|       PRAYYEAAQIDGATPWQQLRFVTVPLLAPTTFFLVITSLIEAFQVFDLVY
                           *    **.:**. *: :  .:*:      :  *   *:  :    * :::  * :

ref|YP_321082.1|          VMTGGGPLNTTNLLVYYIYQEAFGQFDFGYAAAAATVLLAMALVLVYLQL
ref|NP_484832.1|          VMTGGGPLNTTNLLVYYIYQEAFGQFDFGYAAAAATVLLAMALVLVYLQL
ref|ZP_01631485.1|        VITGGGPLNSTNLLVYYIYQEAFAQFDFGYAAAAATVLLAFTLVFVYLQL
RAAC01122                 VMTGGGPDGATTTFAYYIFEKGFQAFNIGESSAASVILILVLACLSYLQM
gb|AAD33665.1|AF135398_2  LITGGGPGNATMTLGVYLYQQGFRSFNFGYASAIAYTVALLAALFSFLQM
ref|YP_001527659.1|       VMTAGGPLGATDVFGFYLYREGFKYSQLGFASAIAYVMFALIFLATVVQF
                          ::*.***  ..:*   *:::.:.*   ::*  ::* : .        :*:

ref|YP_321082.1|          R---------
ref|NP_484832.1|          R---------
ref|ZP_01631485.1|        Q---------
RAAC01122                 RLSRRWVVEES
gb|AAD33665.1|AF135398_2  RLWR------
ref|YP_001527659.1|       RFTR------
                          :
```

FIG. 14

```
ref|ZP_02083881.1|   ------------------------------------------------------MQLFKEIY
ref|ZP_02075264.1|   ---------------------------------------------------------KEIY
ref|ZP_01461962.1|   ------------------------------------------------------LRNLRELY
ref|YP_632791.1|     ------------------------------------------------------IRLVRELY
RAAC01168            MLKWPSTDLKGNPSIRMSTRSTSFKPRIVFETPSPGLLTIWWRTRKVSRVLGVQRMREII
ref|NP_348945.1|     ------------------------------------------------------INSIKEIL
                                                                           :*:

ref|ZP_02083881.1|   AYREMIFSLVRRDLKGRYKGSALGFFWTFLNPLLQLVVYTFVFSVIMKSDVEYYYLHLFV
ref|ZP_02075264.1|   DYRTMIVSLTKRDLIGRYKRSVLGFLWSFIDPLIQLAVYTFLFKIILPTNIPFFHICLFV
ref|ZP_01461962.1|   QYRGLLLSLTQRELKARYRGSVLGFLWTFLNPMLQMVVYTLLFSVYMRQQIEHYPYFMFV
ref|YP_632791.1|     QYRGLLISLVQRELKARYRGSFLGFLWTFLNPTLHMLVYVLLFTVVMRQNIPNFPFFMFV
RAAC01168            EYRPMLTSLVRSELRARYKGSVLGFLWTFVNPLLQLAVYSLVFKVILRSNIRDYPVFLFI
ref|NP_348945.1|     KYKELLQNLTMKELKLKYRNSALGFFWSFLNPIMLLIVYTFAFKYIMHQTTPNYTVTLLA
                      *: ::  .*.   :*   :*:  *  ***:*:*::*  : : **  :  *.  :         : ::

ref|ZP_02083881.1|   ALVPWLFFSMSVSEGCSCIRSQQDMVKKIYFPREVLPIAYVTSQFINMLLSFVVVLLVVL
ref|ZP_02075264.1|   ALVPWLMISSCLTGGCMCVAGGQQDMIKKIYFPREVLPIAFVSAQFINMLLSFIIVFVVLG
ref|ZP_01461962.1|   GLLPWIWFSSSIGAGASAISDRRDLLTKVRFPAQVLPATVVVTNLCNFLLSVPLLIVFGL
ref|YP_632791.1|     GLLPWIWFSTSVGGGASAISDRRDLLTKVRFPAQVLPTSVVVTNLCNFVLSLPLMLVLGM
RAAC01168            GLLAWNMFTGALQSSCGVIVNKASLVKKIYFPREILPASMAGTALVNYVLSLAILIPILL
ref|NP_348945.1|     ALLPWQFFQGAVQGSTTSIISNSNLIKKIYFPRQIMPLSIIFSNFVSFLITLVILFGAMI
                      .*:.*   :  .:        :  .:.*:  **  :::*  :     :  :  :::.  :::

ref|ZP_02083881.1|   LSGRGLNLVALLYLPIIAIVEYLLCLGSALLVSAITVYVRDMEYLLKIVTMALQFLTPVM
ref|ZP_02075264.1|   ASGYGFCGKALLLFPVVVIIEYILALGMTLFFSAVTVYFRDMQQILGALSLILMYASPII
ref|ZP_01461962.1|   VLG-RWPSWHLLFFPVIVLIQFCVTMGLAYLISAINVTFRDLQQIVANLLTMWFFVTPIF
ref|YP_632791.1|     AYG-QWPTWHVVLFPVVVLIQLTFTLALTYILAAINVTFRDLQHIVSNLLTLWFFATPVL
RAAC01168            ITG-FWPTWSWLFAPVAIVAIFFMALGLSLIFSAINVYMRDTEHILNIVLMLWFYGTPVV
ref|NP_348945.1|     VSQ-VPFSFTILLLPIILLLLLVFSVGLSLILSSLNVLYRDVSHFVEVLFMLWFYLTPIV
                       :   *:   :   . :. :  :.::.*  **  ::  :      : :*:.

ref|ZP_02083881.1|   YSIDIVPER--YMAIYVLNPMTPIIVAYRDILYYGKIPRLTTLLHAVLMGVVLLVIGFLV
ref|ZP_02075264.1|   YTLELVPEK--YRPFYMINPITRVIVAYRDIFYYKQVPEFSNIILGLLESIIVLIIGLVV
ref|ZP_01461962.1|   YRTSTVPDQ-FRELVVLANPMAVMVTSYQAIFYDHQMPAPGPLLLWMGIAIVLMVVASSI
ref|YP_632791.1|     YPLSTIQDESARSLMLALNPMVSLMTSYQAIFYEHRLPDAEPLMALAAVSVVLLWAASSI
RAAC01168            YSINSVPHF--LSALFKVDPIAAAILVLQEIFYYREIPHWKMLIYCVVSGVCILWIGWAI
ref|NP_348945.1|     YVLDRIPIL--YKNILLINPMTMIVECIRSVLLEGKMPNPFYIVILVWDIVLLYVGDRI
                      *  . :          . :*:. :  : ::   ..*    ::       : ::  . :

ref|ZP_02083881.1|   FGKLKRRFAEEL
ref|ZP_02075264.1|   FRKLNKHFAEEL
ref|ZP_01461962.1|   FERRREEFAEVI
ref|YP_632791.1|     FESRREEFAESI
RAAC01168            FYKLSRRFAEEV
ref|NP_348945.1|     FRKIENDFAEEV
                      *   . *** :
```

FIG. 15

```
ref|ZP_02085002.1|    ----AIDVAEVTKVYRLYEKPIDRLKESMS-----ISHKN--YHRDFYALNQLSFRVRKG
ref|ZP_01978997.1|    ---ACIEVKDISKCFQIYNKPSDRLKQFIVPKLPLIGKKYNCFYKEFWALKNISVEIKEG
ref|ZP_02075265.1|    ----AIEVQHISKSFKISYDKSKTLKDKII-----FAKKDK--YEIHQVLDDVSFTIEKG
ref|ZP_02083878.1|    -AENAIEVHDIKKSFRVYLDKGRTLKELVL-----FSKRRK--YEERQVLQGISFEVKKG
RAAC01169             MATSAIEVCNVTKSFRVHIGKNQTLKEKLF-----YMGKSK--YRDFIALKDVSVRIPKG
ref|ZP_02045164.1|    --TNAISVEGVSKRFRIYKNRNQSLKGAFL-------QRSRAQFEEFWALDDVSFEIPQG
                         .*.*  :.*  :::          **  .       :   ..  .*. :*. : :* ref|ZP_02085002.1|    ETVGIIGTNGSGKSTILKIITGVLTPTTGEVKVDGKISALLELGAGFNMDYTGIENIYMN
ref|ZP_01978997.1|    EVVGIIGQNGAGKSTLLQLICGTLHQTTGEVIKRGRISALLELGSGFNPEYSGRENVYLN
ref|ZP_02075265.1|    EAVGLIGHNGCGKSTTLKLLTRIIYPDSGEISIDGRVSSLLELGAGFHPDMTGRENIYTN
ref|ZP_02083878.1|    EALGLIGHNGCGKSTTLKLLTRIMYPDSGTIEMRGRVSSLIELGAGFHPDMSGRQNIYTN
RAAC01169             ATVGLIGMNGSGKSTLLKLISRIIYPDKGEIRVHGRVSSLLELGAGFHPEFTGLENIYMN
ref|ZP_02045164.1|    KTFGLLGHNGSGKSTLLKCIAKILTPDRGTISSTGRMAAMLEVGSGFHPELSGRENIYLN
                        ..*::*  .**  *:   :      *  :   *:::::::*:*:**: :  :* :*:* * ref|ZP_02085002.1|    GTMMGYTKKEMDAKLQDILEFAEIGDFVYQPVKTYSSGMFVRLAFALAINVDPEILIVDE
ref|ZP_01978997.1|    ASILGLSKKEIDEKFEDIEKFADIGSFIDQPVKSYSSGMYVRLAFSVAIHVEPSILIVDE
ref|ZP_02075265.1|    ASIFGLTKKEIDERLDEIIEFSELEEFIDNPVRTYSSGMYMRLAFSVAINVNADILLIDE
ref|ZP_02083878.1|    ASIFGLTRKEIDARVDNIIEFSELEAFIDNPVRTYSSGMYMRLAFAVAINVDADILLVDE
RAAC01169             AAILGLSKREVDKKLAEIVEFSELGDFLNEPVRSYSSGMYMRLAFSVAVAVDPEILLVDE
ref|ZP_02045164.1|    GAILGMSKKEIDSKLDAIIDFSGVERFIDQPVKNYSSGMYVRLGFSVSIHVEPDILLVDE
                      .:::*  :::*:*  :.   * .*: :   *: :**:.*****:**.*:::: *:...**:**

ref|ZP_02085002.1|    ALSVGDVFFQSKCYRRMEEIRQKGTTILMVTHDMGSIIKYCDRVVLLNKGEFIAEGPAGR
ref|ZP_01978997.1|    ALAVGDIRFQTKCLRAIDELKKGGTSIIFVTHSSGQIEALCDRVLWLHKGELLVSGEPSK
ref|ZP_02075265.1|    ILAVGDSNFQLKCANKMQELKKEGITIVIVSHSMGQIEELCDRCIWLDKGKIVSDGTPQY
ref|ZP_02083878.1|    ILAVGDANFQAKCFNKLREIKANGTTIVIVSHSLGQIEEICERSIWIHEGKIQKEGNPRE
RAAC01169             VLAVGDAAFQEKCLERVRRLRREGKTIVIVTHDTGVVEQLCDHVVWLHNSRVRMEGRPEE
ref|ZP_02045164.1|    VLAVGDMEFQNKCMDKFAQLKDQGRTVVVVSHGLEQMRTFCDQAAWLDHGTLVDVGAAAE
                       *:***  ** **   . .::  *  :::.*:*.   :  *::   :... .   * .

ref|ZP_02085002.1|    VVDMYKKILAGQLDALKAELER---------------ERQQKESLTG------------
ref|ZP_01978997.1|    VMRHY-------------------------------------------------------
ref|ZP_02075265.1|    VHKLYM-EFMGQARAERSEKER------QLMEEAKNLDLSITKVECKNNAGEPRVAFSID
ref|ZP_02083878.1|    VHPAYL-EYMGQKRPE--------------------AAS-EKVKSEG------------
RAAC01169             CIPHYLDEILGERRGTGMSFDRVEQPPLQPGDELKDLGLGLRVGIREN-------AEVLP
ref|ZP_02045164.1|    VIDTYSDVAHHAVEVEGGGTR----------------FGSGEAMIER------------
                                                * ref|ZP_02085002.1|    -------------------------------EIGQEDAGSGVLTG--------------
ref|ZP_01978997.1|    -------------------------------------------------------------
ref|ZP_02075265.1|    DDINITLYYKIKSPRKVAVQFTVFRSDYMMCYERRTDAEKGTVLLEGEGKIQLKLRKVQL
ref|ZP_02083878.1|    -------------------------------ERPGD------------------------
RAAC01169             NDGGIRVVYEASAAHEVCCEASVVIRRLGDPQELRPRCNEKIALPKGHSVLELHATLDRA
ref|ZP_02045164.1|    -------------------------------IELLSASGQPTSLVYPGDPVR-----LRL ref|ZP_02085002.1|    ------------------------------------------------
ref|ZP_01978997.1|    ------------------------------------------------
ref|ZP_02075265.1|    LL-GHYMID---------------------------------------
ref|ZP_02083878.1|    ------------------------------------------------
RAAC01169             LYPGEYMIELVLQVNDHILRAPATRLWIPHSSQEESLQLQVSVQTA
ref|ZP_02045164.1|    HYRANERI----------------------------------------
```

FIG. 16

```
ref|YP_173899.1|         -----RTKTADAIYYTFVILFGFVMLYPILWMVASSLKPQTEIFGNAASLWPGEFMWENY
ref|NP_241985.1|         ---TKRTWYADVIYYGFVIAFGFIMVYPILWMVASSLKPASEIFSQASSLIPSEFVWSNY
ref|YP_173890.1|         ------------LYHFTVLLFGFFMLYPVLWMISSSVKPPAEIFQQAASLLPSAFHWDNY
ref|ZP_01168682.1|       -----------LLLHVIIIAIGLVMLYPLLWMVSSSFKEPTEIFK-GVSFLPTNFNFDNY
RAAC01276                MTGTIRTRRGIVLAHAVLVIIGFFLIYPVLWMVFGSFKPTNEIFS-SASFWPKHWTFANY
ref|ZP_02087132.1|       ---------GITIYHILVCIGGLIMVYPLIWMLMSSFKETNTIFATAKELLPEKATLVNY
                                  :  :   *:.::::: .*.*       **  ..:  *       ** ref|YP_173899.1|         AKGWEGFGRTGFDVYFSNSIFITTLSVIGAILSSSIVAYGFARLQFRFKKILFACLLGTV
ref|NP_241985.1|         PDGWAGFGRTGFDIYFKNSFIITTSVVIGAILSSSIVAYGFARLQFKFKKVLFACLIATV
ref|YP_173890.1|         VEGWKGFGSVGFDQIFRNSLFVSSMNIIGALISSSFVAFGFARLKFPLKNILFACLIGTL
ref|ZP_01168682.1|       IEGWTGLSGVSFGRFFLNTFILVIFCTIGTVFSCSMAAYAFARLDFKFKKVLFGVMLVTM
RAAC01276                PQGWNAIPGLPFGTFILHSLSVSCLVSVGTVISSSAIVAFGFARFTFRGKSILFGIMMITM
ref|ZP_02087132.1|       VNGWKGFAGSTFGRFFANSAIISVLSTVGAVASSAIVGYGFARCRFKGKKLLFTCMMVSM
                          .**  .:      *.  :  ::    :*:: *.::..:.***  *  *.:**  ::  ::

ref|YP_173899.1|         MLPVQITLIPQYIMFHNIGWVNTFYPLIVPAFLGGTPFFIFLLIQFIRGIPRELDEAAII
ref|NP_241985.1|         MLPVQITLIPQYILFHNLGWVNTFYPLIVPAFLGGTPFFIFLLIQFIRGIPRELDEAAII
ref|YP_173890.1|         MLPMQITLIPQYILFNYFGWVNTFLPLIVPAFVGGTPFFIFLMVQFIRGIPRELDEAAVI
ref|ZP_01168682.1|       MLPFHVTVIPQYIMFNKLEWINTYIPLILPKFLAVDGFFIFLMVQFIRSIPKELDEAAKM
RAAC01276                MLPTQVTLIPQYAMFHDLGWINTYYPLIVPAFFGSP-FFIFLIVQFIRGLPKELDEAAKI
ref|ZP_02087132.1|       MLPFQVMMIPQFIWFKKLGWVGTYLPLIAPYFFGQG-FFIFLIMQFIEGIPRELDEAAKI
                         ***  ::  :***: *:  :  *:.*: ***  *  ..  ***** :***..:*:******  :

ref|YP_173899.1|         DGCSTFGIFWRIILPLIKPALVTVAIFAFMWAWDDFLAPLIYLNSADIQTVSLGLRNFMD
ref|NP_241985.1|         DGCSTFGVFWRVILPLLKPALVTVAIFAFMWTWDDFLAPLIYLNKTDIQTVALGLRNFMD
ref|YP_173890.1|         DGCSTLGIFWRIIMPLCKPVLVTVTIFAFLWSWDDFFGGLIYLNDPSLYTVGLGLASFLD
ref|ZP_01168682.1|       DGCGPIRMFYTLIMPLALPAVITTVIFTFIWTWNDFFSQLLYLSDIKLYTVALGLRMFLD
RAAC01276                DGCNAFTLFVRVILPLIVPALITTAIFSFIWCWDDFFSQLIYLNSAQKFTVPLGLESLAN
ref|ZP_02087132.1|       DGCSYYGVFRQIILPLIIPALITSGIFSFIWRWDDFMSPLLYINKTTMYPISYALKLFCD
                         ***.    :*   :* :**   *.::*  **: *::*:*  *:**..     .*    :  : :

ref|YP_173899.1|         AEGGTSWGPLLAMSTLSLLPQFIIFLFFQKHLVEGIATTGLK-
ref|NP_241985.1|         AESGTSWGALLAMSTLSLLPQFIIFLFFQRYLVEGISTTGLK-
ref|YP_173890.1|         STSASSWGPLLAMATLSLVPQFIVFLFFQKYLVQGIATTGIK-
ref|ZP_01168682.1|       AMGQNSWGALFAMSTLSLIPLFIIFIFFQKYLIEGITAGGVKG
RAAC01276                AVAQEEWGPLFAMSTVSLIPLFLIFFFLQKYVVVRGIATTGLRG
ref|ZP_02087132.1|       PSSTSDYGAMFAMATLSLLPAVIIFITLQKYLVEGIATSGIKG
                         . .  .:*.::**.::**:**:*  .::*:  :*::::.**::  *::
```

FIG. 17

```
ref|YP_949009.1|        ------------------------------------KKANGRDNKAAYIFLLPWLVG
ref|YP_832803.1|        ------------------------------------KKANGRDNKAAYIFLLPWLVG
ref|YP_001361891.1|     ----------------------------------------RQGRAAHVFLIPWLLG
RAAC01277               MTSLRTGPGAPPGHSGKRGDRVAVATTTKANVKAKGEAVKAVRPRNEKVAYLFLSPWMFG
ref|YP_173889.1|        ---------------------ETIRAEYPPNRKTSAKWRVWKQYLVGFAFISPWLVG
ref|ZP_01168681.1|      ----------------------------------------------VGYFFLTPWLIG
                                                                  ...  *:  **:.* ref|YP_949009.1|        LVAITVGPMLMSLYLSFTDYNLLQPPEWVGLDNFIRMFGDARLH-NSLRVTFTYVLVGVP
ref|YP_832803.1|        LVAITIGPMLMSLYLSFTDYNLLQPPEWTGLDNFTRMLSDARLH-NSLRVTFTYVFVGVP
ref|YP_001361891.1|     LVLITAVPLLASLYLAFTDYDLLNAPTWTGLENFRRMGEDPRFWASTWV-TLKYVVVSVP
RAAC01277               LVVFSLGPILVSLYLSFTNYNLLQPPKWIGLENYVHMFTQSQLFATSLVDTLEYILISVP
ref|YP_173889.1|        FLGFVIGPMIASLYYSFTDFDMLTSPNWVGLDNYITMFTNDPRFRTSITVTLVFVFVSTP
ref|ZP_01168681.1|      LIGLSVIPMAASLYFSFTSYDMFTAPEWIGLSNYIEMFNDAK-WLKSVKVTLIYVFLGVP
                         ::    *:  * :.::::  .*  *  **.*:   *   :   .: *: ::.:..* ref|YP_949009.1|        LQLGVALLIALVLDKGLRGLPFYRSIFYLPSLLGGSVAVAILWKQIFGTTGLVNQILAMV
ref|YP_832803.1|        LQLGVALLIALVLDKGLRGLPFYRSVFYLPSLLGGSVAVAILWKQIFGTTGLVNQVLAMF
ref|YP_001361891.1|     LQLAFALALAVVLDKGIKGLALYRSVYYLPSLLGTSVAVAILWRQLFGHDGLINAGLALL
RAAC01277               IKMVVALAIALLLSLEVKGIGVYRTVYYVPSLIGTSVAVAYLWQQMFGPDGLINKGLALV
ref|YP_173889.1|        IKLAFALLIAMLFNNKRKGSGFYTTLFYIPSIIGGSVAVAVMWRQLFGGQGAINDILLFF
ref|ZP_01168681.1|      LQLAFALGVAVLLNRGLKGLQVYRAIYYVPSLFGGSVAIALLWRQLFGGEGLINKVLALV
                        :::  .**  :*:::.    :*   .*   :::*:**::*  ***:*  :*:*:**   * :*  * :..

ref|YP_949009.1|        GIEGPGWISDPNTALGSIILLHVWTFGSPMIIFLAGLRQIPVMYYEAAKVDGATTLQQFW
ref|YP_832803.1|        GVQGPGWISDPSTALGSIILLHVWTFGAPMIIFLAGLRQIPVMYYEAAKVDGASTLQQFR
ref|YP_001361891.1|     GVEGQSWLQNPATALSTIVVLNVWTFGSPMIIFLAGLRQIPEELYEAARVDGAGRWRQFV
RAAC01277               GIHGPNWLAEPRTALFTLAMLQAWQFGSAMMIFVAGLKQIPESLYEAAIVDGAGRLYRFF
ref|YP_173889.1|        GVEGKSWIASPDHALMVLILLVIWQFGSPMIIFLAGLRQIPEDLYEAASVDGAGKFRKFL
ref|ZP_01168681.1|      GIEGQNWISSPDTALYTLIILTIWQFGAPMVIFLAGLKQVPVELYESSLIDGAGPVKQFF
                        *:..*  .*:  .*   **   :  :*   * **:.*::*:*:*    :: :*     :* ref|YP_949009.1|        RITLPMLSPIIFFNLVLQIIGSFQSFTQAFIVSGGNGGPSDSTMFFTLYLYQKGFGQFDM
ref|YP_832803.1|        RITMPMLSPIIFFNLVLQIIGSFQSFTQAFIVSGGNGGPSDSTMFFTLYLYQKGFGQFDM
ref|YP_001361891.1|     SITAPMLTPIIFFNLVLQTIGAFQSFTQAHVISGGRGGPLDSTLFYTLYLYQQGFVNFNM
RAAC01277               RITIPMLSPVIFFNLIMSIINGFTQFTQGYIVTD--GGPLNATLFFALYLYEEAFNFQNM
ref|YP_173889.1|        SITIPLLTPVIFFNLIMQMIGAFLVFTQAFVTT--QGGPLDRTLFYALYLYERAFTNYEM
ref|ZP_01168681.1|      SITLPLITPIIFFNLVMQIISAFQAFTPAYIVSGGKGGPLDSTLFYTLYLYQKGFTQFQM
                        ** *:::*:*****::. *..*   ..: :   *  : *:*::****:...*   :* ref|YP_949009.1|        GYASAMAW------------------------
ref|YP_832803.1|        GYASAMAW------------------------
ref|YP_001361891.1|     GYASAMAW------------------------
RAAC01277               GYASALAWFLLVLVGVLTFLVFRFGSRYVYYES
ref|YP_173889.1|        GYASAMAWTLLIVIAIVTGLLFYSSKKWVFYES
ref|ZP_01168681.1|      GYASAMAWFLLACISVVTAIVFISSKKWVYYQ-
                        *****:**
```

FIG. 18A

```
ref|YP_289760.1|    ----------------------------------------------------VVELRFS
ref|NP_357484.2|    ------------------------------------------------------------
RAAC01278           MKRGGIRMRKKRWTWTASAAAALVLAGCGTAAAQGGSSGSQAGQAAGSADSKPVVTLTFG
ref|NP_241983.1|    -----------------------------------------------------VVLRVA
ref|YP_173897.1|    -------------------------------------------------------LRVA
ref|YP_173888.1|    -------------------------------------------------------LRVA ref|YP_289760.1|    WWGSDERHAMTQEVIELFEEQNPGIKIVGEYTD-WASYWDKLATTTAAGDAPDIITQEER
ref|NP_357484.2|    WWGSQERADRTNKAISAYKQVKPDLDIAGEFAG-WSDYWPRLATQVAGRNAPDLIQMDYR
RAAC01278           FWGDAKEEAVTLAAVKAFEKAYPNIHIQTEFGGPFNQYFTKLSTEVAGGNAPDIMQMDYE
ref|NP_241983.1|    WWGGQERHDMTIEAIELFEEKYPHIQVDPEFTS-WDNYWERLTTQAAGNNLPDVIQMDNS
ref|YP_173897.1|    WWGGQERHTMTLEVIDLFEEKYPDISVEPEYTS-WDNYWERLTTQAAGSNLPDVVQLDYT
ref|YP_173888.1|    WWGSQARHDRTIEAIKLFEAENPDIAITTEFTG-WDGYWERMSTQAAGRNLPDVIQMDLQ
                    :**.  .    *   .:. ::     *  :   *:  . :   *:  :::*  .*. :  **::  :

ref|YP_289760.1|    YLREYAERGALLDLSQLDG---LDLSKIDPLVAESGDLDGATYGVATGVNAYAILADPQA
ref|NP_357484.2|    YIFEYGRRGALAPLDDYIGKG-LKIEDFGKMNIDSGRVDGKLYGINLGVNSSAVFFDKAA
RAAC01278           YIDAYAKEGQLLNLKGAKG---INISTISPSVLKSGYIDGGLYGIPNALNNYAVIYDEAA
ref|NP_241983.1|    KLNEYSSRGLVIDLQSLIADGTINLDDVDDVYQDMNVQDGSVWAVSAGSNALAAIYNEEM
ref|YP_173897.1|    KMNEYISRNLLKDLAPLIEDGSIDLSNVDDVYQDVNTIDDAIYGISLGSNALGMLYNAEL
ref|YP_173888.1|    YINEYVSRDLLVDLTPYVEDGTLDFSDVDDIYLEGGIVNEGLYGINLGSNAMSIAYDAEI
                    :  *  ..  :   *       :.:.  ..      . .  :     :.!  .* .   :

ref|YP_289760.1|    FADAGVDMPDD--DT-WTWDDYVKIAAEISE-KSNGEIVGTQAMGYNETGFAIFARQHGE
ref|NP_357484.2|    WEKSGATPPAT--GQ--TWEEFAENAARLSKNKPKPGYYATADASGVEPSFENWLRQNGK
RAAC01278           FAKAGYHG------QRVSWQQWADILEKVHK--ATGKWAENDDES--WQTFGYWARQHGQ
ref|NP_241983.1|    LEEQGI-QLEPGY----TYEDFYEAMQTLKE-NIDGDFYGYDFGNAEYEMFFVYARQNGE
ref|YP_173897.1|    FAEHGI-ELDGY----TYEDMKASMLKLKS-ALGDGFYGYDFNNTEFDLFFAYARQNGE
ref|YP_173888.1|    FAEAGVPELEPGY----TWDDYIEAVKTIHE-NLDG-MYAYGFG-DSLNFFKHYLRQHDL
                    . *         ::::             :  .                *   : **:.

ref|YP_289760.1|    SLYTEDG-KLGFSK-KTLEKWFQYTVDLLESGAQPGASESVEIEAGGPDQ--SVLATNKG
ref|NP_357484.2|    SLYTQDGA-IGFDP-TDATKWFSLWADLRKSGACVPADVQAL-DQLNIET--NPLTTGKA
RAAC01278           HLYNASGTKLGFTE-STLVSYLNYWANLRKEGVVPPGTVTSLIKQTADPT--DPMVQGKS
ref|NP_241983.1|    SFYNEDGTGLGFEN-QTLIDFLTFVKQMVDDGVAPPHALTLEYIQGGESL----LGDQMA
ref|YP_173897.1|    SVFNETGDGLGYSD-ETLVSYFQFIQGMVEEEAAPPHELTMEYIQGGDST----IADGTT
ref|YP_173888.1|    WLYNEDNTGLGYDDDKYLIDFLNMYKDLLDSGVAAPPDVKAE-VQGIQD--E-LIVHGRA
                    .:.   . :*:          .::    :          : ...  .                     :

ref|YP_289760.1|    AMAHFWTNQLGAISASSGREIELLRYPGETEHERTGMYFKPAMYYSISAGTEHPEEAAKF
ref|NP_357484.2|    ATAFAHSNQFVGYQKLNKSKLAISSYPKSKKDGPSGHYLKPSMLISVANGSAGIEQAVGF
RAAC01278           DAELTWVNYVVSLQSEMTRSLALALPP-TQPGGEEGLYIKPSQFWSIYSKTKYPQQAELF
ref|NP_241983.1|    GAAMAASNGIIGLQQSTEHQLGLMLLP-SLDGGVHGNWIRPSMSYSISSHSEEQEAAALF
ref|YP_173897.1|    SMLLIASNQIIGQQALTEAELDLKPLP-EMEGGTEGNWIRPSMSFAISEHTNQEEHAALF
ref|YP_173888.1|    STFSPHSNQIVALNEAAGRKLQMTTLP-AMEGGSEASFIKPSLLFSATSQGDKSEEAARF
                    *  . . .   .: :    *     .  :::*:      :            : *  * ref|YP_289760.1|    VDFLLNSEEAAAILLADRGLPANVEVRESI---VDALPEADRRSAEFLAEIEGTIVDG--
ref|NP_357484.2|    INFLVAEPEGIDILGVERGVPASESMRNAL---SSKLDEVSKIMVDYIAEITPGVGDLP-
RAAC01278           VNFLLNNVQAGKALGLVRGIPVSSSVRTQLM--ASGTSAPEKAEFQLVNEALKVATPID-
ref|NP_241983.1|    IDFLTNDLQANEILKAERGVPISSKVREHL---APMVDGPIAKTEFEFLELVADYTSPAD-
ref|YP_173897.1|    IDFITNDPEANEILQAERGVPSAEIRSHL---EGKVSPEVEKTFAYLEYVAENSAPAD-
ref|YP_173888.1|    INFFVNSIEANEILNAERGVPISEKVRDHLY---DHVSENTQLQFDYVQLVEQRAAPIH-
                    ::*:  ..  .:.        *   **:*  . ..:*   :                     :
```

FIG. 18B

```
ref|YP_289760.1|    NPPPPPIGAGQVVDIIKRINDDLMFGRLTPAEAADRFIKEVED-------
ref|NP_357484.2|    -PAPPPGAGEFAFVLKRTAEEVGFGKISPEEGGDRLVKESETVIK----
RAAC01278           -PPPPQHDKEIDQDFANMVQAVQYGKETPQQGAEQFMQEANDLLQNGGE
ref|NP_241983.1|    -PLPPPGESEVRGAFLRMIESVKYERLSIEEATEQFREAEQILR----
ref|YP_173897.1|    -PLPPPGESEVRAAFLRVVESLKYGQTTPEDGAEQFRQQAESILK----
ref|YP_173888.1|    -PPDPAGTGQILDLYARMIEEFEYELLSAEEFAERFRGEVEIILSN---
                     *  *        :.      . : .:    :  :  :::   : :
```

FIG. 19

```
ref|NP_693016.1|       ------------------------------------------------------PT
ref|YP_174646.1|       ----------------------------------------------PVGGNREAV
RAAC01279              MMKEGSPVPRGASNERVEALVRLLGLEPSEKPRSLSELVADREVHVLLPEGTAPAGGYPT
ref|ZP_01854967.1|     -----------------------------------------------------P-----A
ref|ZP_01088898.1|     -----------------------------------------------------P-----A
ref|ZP_01924075.1|     ---------------------------EKLRFSPEEGEEACIYICLPELPPP---YKT
                                                                                  .

ref|NP_693016.1|       VLALHGH---GYG-MKEAIGLNINGEQCKFTGIHNKFAARLV-NKGVIVVVPGIIGFGDR
ref|YP_174646.1|       VLALHGH---GAG-AEEALQEDSS---------HNAFALKLV-EQGAVVVLPELAGFGAR
RAAC01279              AVLIHGHSPLGYDYFRSANEVYVKG---------APVAELLRDAGFAVVLPSLRGFGAT
ref|ZP_01854967.1|     IVCMHGHS--GIIPYID--EGKTKADKEKTRQSELDYAVYFA-KHGYITAAIVMRGWNET
ref|ZP_01088898.1|     IICLHGHS--GIDPYIR--LNEDEKQKKKTDESALDYAVYMA-EHGYVTAAMVVRGWNET
ref|ZP_01924075.1|     FICLQGHS-TGMHNSI--AVEWQDETVPKAIEGDRDFAIGCL-KRGIAAVCLEQRYMG--
                         : ::**    *           .            . .   * ..        .

ref|NP_693016.1|       RLDEDMNAEQPLENSCFEIGSQLLLMGKTLAGLRVQEIKRVLDYIQSFNMVDEEKIGSFG
ref|YP_174646.1|       KRKQDQAE----KNSCFSIASHLLLYGKTLAGLRVFECARLLDWVGETRRGNVGCI---G
RAAC01279              MDPVDRALG--LEHSCERFARQRLLVGRTLLGDRVRDLMELLDAMEMDGRFDIESLVTAG
ref|ZP_01854967.1|     AGDQDRG-VSHTKRSCLQMTMNALLIGSTPQGQRSWDAMRVIDFLQTQDQVDPDRIAAAG
ref|ZP_01088898.1|     CGRRDAGYKSTHLRSCHEMSMNAFLMGMTPQGIRCWDAMRVVDFLQSREEVDPDKIGVGG
ref|ZP_01924075.1|     ----ERSSDPEHHPACLLPTLQNLMIGRTAIGDRVYDVDRLIDYLYTRGDIDRTRLGVMG
                            :         :*    : ::  *  *  *   :  .::* :    :  :    * ref|NP_693016.1|       FSGGGLVAAFTSILDERIKATVLSGYLSTFKGSIMSRRHCLDNYIPGILEIGEMDELIAL
ref|YP_174646.1|       FSGGALIALLLAATDERIKATVLSGFASLMRDSILASRHCLDNYIPGLLAIGETPQLLEL
RAAC01279              FSGGGTAALFHAACDSRVRHLILLSALCTARHSLLATRHCLCNYVPGLLNFGDWGDVAAL
ref|ZP_01854967.1|     LSGGGATAMYLPILDERVKLTMIAGAFSTYRASYYSMPHCLCQCMPEMMRFGEMSDVVAL
ref|ZP_01088898.1|     LSGGGTLTMYLPILDERIKLAMIAGAFSEYRTSIFSIHHCICNCLPGVMRHGEMADVVAL
ref|ZP_01924075.1|     NSGGGTTGMFAGAVLDRITHVIASCSFSSFRGSIGSMFHCACNYVPGLLEYGESADVVGL
                        ***.             .*:   :       . : *  :  **   : :*  ::  * ref|NP_693016.1|       IAPRPLFIESGKDD----------------------------------------------
ref|YP_174646.1|       INPRALFVESGNDD----------------------------------------------
RAAC01279              VAPRRLTIVHGERDGVFPFEGARAAFAAVEAAYEAVGMTKRAMFLAQPGGHEPYPEVLWQ
ref|ZP_01854967.1|     HAPRPVLLINGIDDKI--------------------------------------------
ref|ZP_01088898.1|     FAPRPVLLINGIDDPI--------------------------------------------
ref|ZP_01924075.1|     TAPKPVVIVNGDADEIFPLDEADRQFRRLEAVYRAAGAAGNCVHAVGGGGHRFYAAEAWS
                        **: : :      *  * ref|NP_693016.1|       -----------
ref|YP_174646.1|       -----------
RAAC01279              LMGVGLKRATT
ref|ZP_01854967.1|     -----------
ref|ZP_01088898.1|     -----------
ref|ZP_01924075.1|     AM---------
```

FIG. 20A

```
ref|YP_001479789.1|    MFKNLRWTIVFLLFMVYMINYLDRVALSITVPMIEKDLMLNAEQFGIIF
ref|YP_001585330.1|    MKTRYRWWVGALLFGAGMLNYLDRAALSVVAPIIKRDLGISDAQMGVLF
ref|YP_001523023.1|    --TRYRWFVIFLLFAITVVNYIDRAAIAYAITAMERDLGLSPAAAGSIL
ref|ZP_01746012.1|     --SHYRWVVVALLFAIVVINYIDRSAISYAIDPISKELSLTASQKGLIL
RAAC01316              MATRFRWVIIGLLFFITVVNYIDRSAISYAIGDIAQVLHLNDSQVGMIL
ref|NP_845565.1|       MKNKFRYYVFTMLTFITIVNYIDRGAIAYAQSFIIKEYGFDPKEWGAIL
                         .. *: :  :*      ::**:** *::  .  : :    * ::

ref|YP_001479789.1|    GSFFFGYAIFNFIGGLAVDKFGPTLVLGIAVGLWSIFCGMTALA----------TGFYSM
ref|YP_001585330.1|    SSFFVGYCVFCFVGGWAADRFGPRRVFAWAAGVWSLFCGATALA----------GSFVHL
ref|YP_001523023.1|    GAFGVGYAITTLLGGFAVDRYGARLVLTISAVLWSLSIGGTAMA----------TGFASL
ref|ZP_01746012.1|     GAFGVGYMFTTFIGGVLTDRFGPRIILTVAVILWAVSSALTAVA----------SSFFLL
RAAC01316              GAFGIGYMITTFFGGIWVDHVGARWALFFASLLWSLSIGLTGVA----------ASFTVI
ref|NP_845565.1|       GYFGYGYMIGSLLGGIFSDKKGPKFVWIVAATAWSIFEIATAFAGEIGIAVFGGSALIGF
                       . *  **  .  :.**  *: *.      :   *::    *..*         .: :

ref|YP_001479789.1|    LILRVLFGMAEGPICASANKMINGWFPKKQAATAMGLLSAGSPLGGAVAGPIVGYLALAF
ref|YP_001585330.1|    LVVRVAFGIGEGPMGTTTNKAISNWFPRREAGRAVGWTNAGQPLGAAIAAPIVGLVALQF
ref|YP_001523023.1|    YAARVLLGVSEGPNFPALTGAVSRWLAPNERATALGNALVAVPVALAIGGPIVTQLLAHL
ref|ZP_01746012.1|     LALRLLGLAEGPMFPGLTGAVAHWLSPKERAKALGYSLAAVPLALAIGGPIVSGILSLT
RAAC01316              YLMRILLGVAEGPNFPAVNRAVGDWLSPRERAIALSNSLVAVPLALAIGAPIVTSLILGV
ref|NP_845565.1|       AIFRVLFGLTEGPSFAVSNKTAANWAAPKERAFLTSLGFVGVPLGAVLTAPVAVLLLSFT
                         *  :*: ***       .     *    .: ..  .: .*:.  :

ref|YP_001479789.1|    GWRPAFMIICSIGIVWMLVWFFVVADNPAKSKRVSDKELALI--NQMKE-----ETHSAE
ref|YP_001585330.1|    GWRVSFVVIAALGFLWLVAWWRLFRDEPAAHPRVSLEEAREIAADRGVD-----AVHGTR
ref|YP_001523023.1|    DWRTAFGVLFALSIMWVPLWLVFFRNRPEDSRFVNAAELAHIRTP--------DATGPAK
ref|ZP_01746012.1|     DWRSLYWILAVGSLVWFPLWFWMFRNRPEDSAHVNEAELAQIRHKDIEVIDTGRGTGEVV
RAAC01316              GWRGMFIILGIVGLLWVPVWFFLFRDFPEHSRHVNDEELRHIRAS-----EHVDRTRPAK
ref|NP_845565.1|       SWKIMFFILGTIGIVWAIIWYFTFTNMPEDHPRVTKEELAEIRSTEG-----VLQSAKVE
                       .*:  :  ::   .:*   *   .: *  *.  *    *           .

ref|YP_001479789.1|    EELSNAAHGLG------YYLKQPIILVTAFAFFCYNYILFFFLSWFPSYLVQAHNLNIKE
ref|YP_001585330.1|    DVHAADAH--AARPLLHYLL-SRPVLGVALAFFSFNYVLYFFLSWLPSYLTDYQHLNIKQ
ref|YP_001523023.1|    P----AAGH--GPGLARLLLTNPTLVSNYWAFFVFGYFLFFFMTWLPSYLEQAYHLNLKQ
ref|ZP_01746012.1|     P----ASDNATA-TTWKRLFTNPTLLANYWAFFVFGYFLFFFMTWLPGFLEQKFSVSVAN
RAAC01316              EMRFRQAHHVSSGTLWKYLLVNRTLMANNWSFFVFGYYLFFFMTWLPSYLKSEYHLNLKS
ref|NP_845565.1|       KEIPKEP--------WYSFFKVPTFVMVTIAYFCFQYINFLILTWTPKYLQDVFHFQLSS
                       .        :       .:    ::*  * :::::*  * :*  .    ...: .

ref|YP_001479789.1|    MSLTTMIPWIVGFVGLALGGYISDKIFNITGKLLLSRKIVLVTSLLAAAVCVALAGTVSS
ref|YP_001585330.1|    MSVVGILPWLGATVGFVAGGTVSDRIYRHSGDVLFARKIVIVVGLGVAAACVLLASRVNS
ref|YP_001523023.1|    VGLFTVLPWLAAAVALWSMGRWSDHLLRTTGRLRVARSYLIAGSQLVAALAIVPVALTDN
ref|ZP_01746012.1|     VGWFSFVPWAVAGVVLLLLGNLSDGLLEKTQSLRISRSWFIIVTQLIAAVVIVPVAFTST
RAAC01316              VGAFSILPWALATVLLWLVGYLSDWILRRTGSLRLARSYPIWISQLLSALCVVPLTFTHD
ref|NP_845565.1|       LWYLGMIPWLGACITLPLGAKLSDRILRKTGNLRLARTGLPIIALLLTAICFSFIPAMNN
                       :   .:**  . ::    .  **  .  :    :  :..:*.        :*  .

ref|YP_001479789.1|    VVPAVMLMSVSIFFLYITGAIYWAIIQDVVHKSRVGGASGFIHLVGSVSGIIGPVVTGYI
ref|YP_001585330.1|    LGAAVTLIAIASLFAFMAPQACWSLLQEIVPRERVGAAGGFVHLLANLAGILSPSLTGWL
ref|YP_001523023.1|    LAVAITGITVAVAASMGSNAAYYAVNVDVVP-ERAASALGIMDFAFALAGFLAPAITGWV
ref|ZP_01746012.1|     LWVALALITVALASSMGANAVYYAINVDIAP-DRSATALGLMDLFFAVSGFAAPAITGWI
RAAC01316              LTTAIVFITLAVGFGMSANSTFYAMNVDLMR-ERTGTALGLMDTFFAAAGFLAPVITGWI
ref|NP_845565.1|       YVAVLALMSLGNAFAFLPSSLFWAIIVDTAP-AYSGTYSGIMHFIANIATILAPTLTGYL
                        .:   :::.    .   :::  :     .    *::.    :  :.*  :**::
```

FIG. 20B

```
ref|YP_001479789.1|    VQNTGKFDSAFMLAGGVAALGAVLVLL----------------------
ref|YP_001585330.1|    VQYGGGYAGAFVLAGASALAGAAILTVAV--------------------
ref|YP_001523023.1|    LALRGSFTDGFALMAALALSSVVVVLLFHHPDRHR--------------
ref|ZP_01746012.1|     VGSSGSFTRAFFILAALAGSSVVLTFLFHRPDR----------------
RAAC01316              VNATGSFKSAFWLMAVLSATSVLAVLIFHQPDKQRRIESAVAPSSNLTH
ref|NP_845565.1|       VVSYG-YPSMFIVAAILAAIA-MGAMLFVKPGQQTKTES----------
                         :   *  :  *  : .  :  .       :
```

FIG. 21

```
ref|YP_001488480.1|      ------------------------FLEPLNILNLLRQISINALIAFGMTFVILTGG
ref|NP_693494.1|         ------------------------FLDPANIMNLLRQISINGLIAFGMTFVILTGG
ref|ZP_02171111.1|       ------------------------FLSPNNLMNVLRQVSINALIAFGMTFVILTGG
ref|YP_001113858.1|      ------------------------SDRFFTTSNLLNVARQVSINTLLGVGMTFVILTGG
RAAC01502                MTWFRRYRLGPLLGLVLLILILAVASRQFFTASNLLDIALQTSVNALLAIGMTFVILTAG
ref|YP_878667.1|         ------------------------SPRFLTVPNIKNVLTQVSVNAIIAIGMTFVILTGG
                                                 *:   *: ::  * *:* ::..********.* ref|YP_001488480.1|      IDLSVGAILALSSALTAGFIVSGMDPILAIIVGSIIGAILGMVNGLLITKGKMAPFIATL
ref|NP_693494.1|         IDLSVGSILALSSALAAIMMTSGIDPILAVIIGVLLGAVFGALNGILVSKGNLAPFIVTL
ref|ZP_02171111.1|       IDLSVGSILALSGAVTATLMASGVDPVLSVLIGLLAGAALGAFNGIIIAKGKVAPFIATL
ref|YP_001113858.1|      IDLSVGSILALAGALGAGFLGQGNTTLMVVLYACLIGLLAGTVNGTIVAYGRVAPFIATL
RAAC01502                IDLSVGSTLALTSAIAAQWMVGGTSPWLAGISALCIGAIAGAFNGVLVAYARLAPFIVTL
ref|YP_878667.1|         IDLSVGSTLAISGAVAATLIKANCSIFVAIIVAIIVGIIVGLVNGVVIAKGKIQAFIATL
                         ******: **::.*: *   :     :  :.    *   * .** ::: ..: .**.**

ref|YP_001488480.1|      ATMTIFRGLTLVYTDGNPITGLGSNYAFQLFGRGYFLGIPVPAITMLLTFIVLWVLLHKT
ref|NP_693494.1|         ATMTIFRGLTLVFTDGKPITGLGDSYAFQLFGKGYFLGIPVPAVTMIIAFVILWFLLHKM
ref|ZP_02171111.1|       ATMTIFRGLTLVFTDGRPVSGLGDSTFFDMLGRGYLFGIPVPAVTMMVSFLVLYLILKKT
ref|YP_001113858.1|      ATMTLFRGATLIYTEGRPVRAVAEG--FNELGGGYLGAIPTPVIITSVIVLLAWFVLTQM
RAAC01502                GTMTLFRGLTEIYTNGQPIFNLPYS--FNGLGNGAVLGVPVPVWITMIVFLIAWMVLSRT
ref|YP_878667.1|         ATMTVFRGVTQVYTNGTPVSKLGEA--FGKIGNTEIIGIPLPVVITIAVFLVAFYVLNET
                         .***:*** *  ::*:* *:  :       *  :*   . ..:* *.    .:: : :* .

ref|YP_001488480.1|      PFGRRTYAIGGNEKAALISGIKVPRVKIMIYSLAGFMSALAGAILTSRLNSAQPTAGTSY
ref|NP_693494.1|         SFGRKTYAIGGNEKAAKISGIKVDRVKIFIYSISGMMAALAGMILTSRLNSAQPTAGTSY
ref|ZP_02171111.1|       TFGRRVYAVGGNEEAAVLSGINADRVKIYVYSLTGFLAALAGTILTSRLSSAQPTAGQMY
ref|YP_001113858.1|      TPGRRIFALGGNEEAAILSGIRTNHYKIMVYSISGLLAGLAGVILSSRLLSAQPTAGIGY
RAAC01502                VAGRRIYAIGGNEKVAYLAGVRAKRYLVAVYVVSGILAALAGLILTSRLATAEPTAGQGY
ref|YP_878667.1|         RCGRYIYALGGNEDSARLSGINTTKMKMLVYVISGVTAAISGVVVTSRIGSASAIAGTGY
                           ** :*:****. *  ::*:.. :   : :* ::*.  :..::* :::**: :*.. ** * ref|YP_001488480.1|      ELDAIAAVVLGGTSLSGGRGRIVGTLIGVLIIGVLNNGMNLLGVSSFYQSVVKGIVILIA
ref|NP_693494.1|         EMDAIAAVVLGGTSLAGGKGRIAGTFIGVLIIGILNNGMNLLGISSFYQQVVKGVVILIA
ref|ZP_02171111.1|       ELDAIAAVVLGGTSLTGGRGWIVGTLIGALIIGVLNNGLNLLGVSSFFQQVVKGSVILLA
ref|YP_001113858.1|      ELDAIAAVVIGGTSLTGGQGVIGTLIGALIIGVIDNGLNLLNVSSFYQQAVKGLIILVA
RAAC01502                ELDAITAVVLGGTSLFGGEGTLVGTIIGALILGVIDNGLNLLNVSSFYQDAVKGLVILIA
ref|YP_878667.1|         ELDAIAAVVLGGTSLAGGEGSIAGTIIGALIIGVLNNGLNLLNVSPYYQLIVKGLVILLA
                         *:*:*:*** .* :  :.**:*::::*.:*.::: * ::* ref|YP_001488480.1|      VLLDRKKS---
ref|NP_693494.1|         VLLDRKKS---
ref|ZP_02171111.1|       VLLDRKKN---
ref|YP_001113858.1|      VLLDRRNAVGR
RAAC01502                IMLDRKRSEGR
ref|YP_878667.1|         VMVDRK-----
                         :::**:
```

FIG. 22

```
ref|YP_001275707.1|    ------------------------------------------------------------
RAAC01599              -----------------------MTMSVIDAFLRSTAQTAAEPSPGPSRLREGILAACL
ref|YP_114375.1|       ------------------------------------------------------------
ref|YP_001254026.1|    ------------------------------------------------------------
ref|YP_001390860.1|    ------------------------------------------------------------
ref|YP_001568000.1|    ------------------------------------------------------------ ref|YP_001275707.1|    ---------------------------------GLANYEKLFNDKLFWQSLRVSAIY
RAAC01599              LAPALLFLVAFVYAPAVLAFALAFFNFHPGGTATYAGLSNFHAALSDPLFWRSMANTGLY
ref|YP_114375.1|       --------------------------------FVGLDNYRRLFGDPEFWQALRNT-LY
ref|YP_001254026.1|    --------------------------------GLDNFYYIFSDKEFLIAMKNTFIY
ref|YP_001390860.1|    --------------------------------GLDNFYYIFSDKEFLIAMKNTFIY
ref|YP_001568000.1|    --------------------------------GNASFIGFENYVNLMHDPLFWRALLNT-LY
                                                       *: *:    :  *   *  ::    :* ref|YP_001275707.1|    SIVS-VPLGLTIALGLALLL-NHKMRGIM-VFRSVYYLPTVISGVGVAMLWRWLFNGDFG
RAAC01599              ALMM-VPSTLVLSVALAALL-QSNRRLFR-FAQSLVVLPYITPAVGTAIGWLWMYNPNFG
ref|YP_114375.1|       FVAVGGPLSVLVSLAAALLV-NHRLAPFKGLFRSLLFLPVVTTLVAVAVVWRYMYQPRYG
ref|YP_001254026.1|    VLYV-MPISIILSLIIAILLN-SNIKFRG-FFRTIYFIPFITSTVAISMVWRWMYHADHG
ref|YP_001390860.1|    VLYV-MPISIILSLIIAILLN-SNIKFRG-FFRTVYFIPFITSTVAISMVWRWMYHADHG
ref|YP_001568000.1|    ALVVAMPITIVLSLSFAALINREATYFKN-FFKVSFYLPSITNTVAIAIVWAWMLNPDYG
                         :    *   : ::: * *:      .:    :*     *. :: * ::  :   .* ref|YP_001275707.1|    IINVLLRGVGIRGPNWLFDETWALVALIIASLW-GIGGTMLIFLAGLQGIPQELYEAAEI
RAAC01599              ILNALLRGIGLKPIGWLNSPHWAMPAVVLYSLWHGIGFDVLILLSAMSQVPEGVLESARV
ref|YP_114375.1|       ILNHLLGRFGLEPVDWLGDPDWAMPAIIVMAVWKNFGFNMIVFVAGLQSIPESLYEAASI
ref|YP_001254026.1|    IINYLLQVIGLSPVKWLSDPKWAMPSLIILSIWKSLGYNIVIFLAGLQNIDEQYNLAAKL
ref|YP_001390860.1|    IINYLLQVIGLSPVKWLSDPKWAMPSLIILSIWKSLGYNIVIFLAGLQNIDEQYNLAAKL
ref|YP_001568000.1|    LLNWFLGLFGIQGPNWLGDPLWAMPSVIMLVVWKAVGYNIILFTAGLQNIPDYLYEAAEL
                       ::* :*  .*:     **  **: ::::   :*   .*   :::: :.:. : :   :* :

ref|YP_001275707.1|    DGAGRWRQFSSITLPMISHVTFFNLVLGVIGALQVFTDAYV--ITGGGPNNATLFLSVYL
RAAC01599              DGAGPWTRLFRITLPLISPTLFFIGVITTIGSLQAFAQVYALSLSSGGPENATLTALLYI
ref|YP_114375.1|       DGAGHRRQFFHITLPLLAPTFLFVAVITVIGHFQLFAEPYV--MTQGGPAGSTLSLALLM
ref|YP_001254026.1|    DGANKWERIKNITVPLLSPTIFFVCIMTLISSFKVFGEIFALFDKQPGPLNTCLTMVYYI
ref|YP_001390860.1|    DGANKWERIKNITVPLLSPTIFFVCIMTLISSFKVFGEIFALFDKQPGPLNTCLTMVYYI
ref|YP_001568000.1|    DGASRFQQFLHVTIPSLRPTIFFVTVMTVIGYLQLFEEPY--MLTSGGPLNATLSIVLYL
                       ***.   ::   :*:*  :    .:*   ::  *.  :: * ::         . **  .: *         :

ref|YP_001275707.1|    YRHAFQYLNFGYAAAVAWVLFLIVLALTLL------------
RAAC01599              YQQAFTNGQFSYAAAMAAMLVVCIFAVTALTRWIGHRLTFYQ
ref|YP_114375.1|       YQQGFRWWNLGYAAAIAFVLFGIVGSFAV-------------
ref|YP_001254026.1|    YNKFYNQYQYGIASAAVFVLFIIISLFNFIQFYIGKKKVEY-
ref|YP_001390860.1|    YNKFYNQYQYGIASAAVFVLFIIISLFNFIQFYIGKKKVEY-
ref|YP_001568000.1|    YRQGFEFFKLGYSSSIAFVLFLIIFALT--------------
                       *.: :     :   .: ::: .. :*.    :  .
```

FIG. 23A

```
ref|YP_001089934.1|    ------------------------------------------------------------
ref|ZP_01801573.1|     ------------------------------------------------------------
ref|YP_076008.1|       ------------------------------------------------------------
RAAC01600              MVLTQYSAIQRGRIHVRRSWVLGTASAVILAGAGTGVALDRGHAHDAVRVAPAEAASANG
ref|ZP_01850509.1|     ------------------------------------------------------------
ref|YP_001624170.1|    ------------------------------------------------------------ ref|YP_001089934.1|    -SNITKIDFWA--PLGGTNGETAQKMVDQFNSEHKDVQVNMLKQKDYYENATKLQAALTS
ref|ZP_01801573.1|     -SNITKIDFWA--PLGGTNGETAQKMVDQFNSEHKDVQVNMLKQKDYYENATKLQAALTS
ref|YP_076008.1|       -VKVTFWHAM-----GGVAGEAVQRLVDQFNSSQDKVEVEAVYQGTYDDALQKLRAAGS-
RAAC01600              VVQITFWNGHP----SGALKKEMHTLVDEFNATHPHIHVTVIDK---YAQIQPVTAAMTA
ref|ZP_01850509.1|     ---------------GALARTMTGLVKEFNEAHPGTRVTPVFTGSYDDTLLKTRAAIKA
ref|YP_001624170.1|    -VTISFMHAMS----TGALKTSLTKITQDFMAKNPNITVDLQEQPDYATLQTKINAQTAA
                        *.          :..:*   :    *                           * ref|YP_001089934.1|    KDQPDVTLLEITQTGTFASAGALVDMSKYFDK----TYQER---FFSGLLTNSYYE-DKF
ref|ZP_01801573.1|     KDQPDVTLLEITQTGTFASAGALVDMSKYFDK----TYQER---FFSGLLTNSYYE-DKF
ref|YP_076008.1|       -DGPTIMQVYEIGSRFMIDSGMITPMQNFVDA-DGFSIDD----FEPNILGYYTFD-GRL
RAAC01600              GDAPNVIMPHLDAAQQFAADGYLVNLTPYIDGPSGFTKAQLSSFFYPSVWNGRAIEPGKQ
ref|ZP_01850509.1|     GKPPGAVIMSANFLTDLAIEREIAPFDDLIAAEGGTPDAFMDQFF-PAL-KGNAVVERKV
ref|YP_001624170.1|    GTPPMIAQVYSNLADEFASSKVIVPLDDYVSQSKDYGN------FYDGVKKDLKLTDGKT
                             *       :   :.  .             *  :         :

ref|YP_001089934.1|    VG---------MPFNRS-TPILYINKDMATKAGLDPSGP-KSWEELKDYASKMTNK---
ref|ZP_01801573.1|     VG---------MPFNRS-TPILYINRDMATKAGLDPSGP-KSWEELKDYASKMTNK---
ref|YP_076008.1|       YS---------MPFNTSTP-IVYYNKDAFREAGLDPERPPRTFEEFKEYARKLTVTQG-
RAAC01600              YI---------LPFEENGHMVIFYNADLFKKAGIS--SPPKTWQQLRADARKITALGG-
ref|ZP_01850509.1|     YG---------VPFH-NSTPLLYYNVEQFREAGLDPDAPPRTWDALAAAARKLTRREGG
ref|YP_001624170.1|    RM---------WPFNKSV-VVQYYNPTMVPEA-------PKTWDDFATAAKKAST---G
                                  **. .  : : *   :*       ::::  :    * * :

ref|YP_001089934.1|    SEDTYGFETP----IDIWF--YEAMVMQSGGEI---TNGK--------KVAFNNEAGQAP
ref|ZP_01801573.1|     SEDTYGFETP----IDIWF--YEAMVMQSGGEI---TNGK--------KVAFNNEAGQAP
ref|YP_076008.1|       GETRYGASIA----LYGWF--FEQFLAVQGAHYVDNDNGR----SARATKAIINSPEGERF
RAAC01600              SIHGIAWTPS----MEQFL----TMVADNSGKIWASSSET--------RFALNNPQAVAT
ref|ZP_01850509.1|     RVTRWGIMMPSNYDYGGWILQALTL--SNGGRWYNEEYGG--------EVYYDTPTVLGA
ref|YP_001624170.1|    NVVALSIDPGNSSGPAGGTALFEIMAQSFGDPVFASDGTP--------QFTKDG--VVKA
                               .                 :                         .    :

ref|YP_001089934.1|    VKFWQDMMKAGIMKMPPGEDYNAWDVAKQDFVNGKVGMIFTSTADLAGLMQQTEGKFEIS
ref|ZP_01801573.1|     VKFWQDMMKAGIMKMPPGEDYNAWDVAKQDFVNGKVGMIFTSTADLAGLMQQTEGKFEIS
ref|YP_076008.1|       VTWLKEMVDEGVAINLG----RRTADTQAAFSSGQVAMTLDSTAALGNILNGVGDKFEIG
RAAC01600              LSFLRDLVAQGDMILTQN------YDYQLDFGTGNIGLLIESSAGWTYDVQSVGGKFPVK
ref|ZP_01850509.1|     LSFWADLVHRAKVHPAG---EIKGPAVTAAFLSGQAAMMIISTGSLTFIRDSA--KFPFR
ref|YP_001624170.1|    LDYLKQMKKDGSLALGTK------YPGQAALGGQTGAFDISSVASYQFNKAAVGDKFAMG
                       : : ::   .                 :     .:  * .       . ** .

ref|YP_001089934.1|    TAFLP--KNQKYATP--TGGANLVMLEGGTDKEK-EASAEFIEWMTQTDKIVQFSSSTGY
ref|ZP_01801573.1|     TAFLP--KNQKYATP--TGGANLVMLEGGTDKEK-EASAEFIEWMTQTDKIVQFSSSTGY
ref|YP_076008.1|       TAFLPRPEGAAEGGV-IIGGASLWITNTKPLKEQ-WAAWEFVKWLTTPEVQAEWSIATGY
RAAC01600              ASPAP--AGTSGRAYNYVDGDSLAILNTGTKAQQ-DAAWTFIRWLASPAENAQWDQAANY
ref|ZP_01850509.1|     VAFVP--MNV--RPAVPIGGASL-VQPTGLDPETRKAGWTLIRWLTSPAISGRWSRATGY
ref|YP_001624170.1|    VAALP--SGPAGTA-NQLAGTKIALFDKSTDAQK-AAAWKFMQFLTSPEEMAYWSSTTGY
                       .:  *   .             *  .:  :    : *.  ::.::: .  :. ::.*
```

FIG. 23B

```
ref|YP_001089934.1|    LPTTEDATNSEKLQTLYKEKPQYKVA--------TDQLQYAVALPMLNG--YKEATDKLM
ref|ZP_01801573.1|     LPTTEDATNSEKLQTLYKEKPQYKVA--------TDQLQYAVALPMLNG--YKEATDKLM
ref|YP_076008.1|       FPVRKAAYDQQILKDWHAQRPQFTTA--------IEQLRASPLSTVTQG-------AVIG
RAAC01600              LPIGPAAAAQ--LKPYYASHPDQAAA--------FTNPSTWLTDPAANATQYYAALTAMQ
ref|ZP_01850509.1|     FAPNRAAYDLPEMRAFLAGNPDAKIA--------VDQLANAKPWFATYR--TVPVRKAIE
ref|YP_001624170.1|    LPVSKDTLDQPVFKDYVAKN----------------------------------------
                        :.       :       ::        .

ref|YP_001089934.1|    DEIKKGLTDLNANPKDVVSKGTSAMQ--------
ref|ZP_01801573.1|     DEIKKGLTDLNANPKDVVSKGTSAMQ--------
ref|YP_076008.1|       T-FPQARQIVEAAMESVVLGQATAAEAL------
RAAC01600              TELLKALNGQESPQQAIANMNTVGNQYLSGERRS
ref|ZP_01850509.1|     DELQAVLAGKRQPKEALAAAQTSADAIL------
ref|YP_001624170.1|    ----------------------------------
```

FIG. 24

```
ref|YP_001327980.1|    ------------------------------------------------------------
ref|NP_436764.1|       ------------------------------------------------------------
RAAC01625              ----------------------------------MRGLWQSGRRREGLRLMRRIL
ref|ZP_01189621.1|     ------------------------------------------------------------
ref|NP_463711.1|       ------------------------------------------------------------
ref|YP_001527658.1|    ------------------------------------------------------------ ref|YP_001327980.1|    -------VAAILALMTVFPLLWMVSIAFKGAQESFSPALL--PSAPTWS--NFVYVLTEV
ref|NP_436764.1|       -------VTAILAFMTLFPLLWIVSIAFKPAAESFSSNLI--PQAPTLD--NFIYVLTGV
RAAC01625              TILAAYFVLAVGAFISIFPYLWAVLTSLKPESEVFTSHFLSLPTHIEWA--NYTHVFQQI
ref|ZP_01189621.1|     -----YFILLFFLVITLYPFIWMVLTSFKIESDIVSYPPTLIPRTFTLK--SYLNIWKSI
ref|NP_463711.1|       --ILTYTIICLGGIIMLMPFVWMVSTAFKTGAANMVLPPQFIPKEPTTA--NFTQVFEMF
ref|YP_001527658.1|    -LLLTHGVLLFGAFLAAMPFLWVITTSLKPNGALYQPPLL-LPTHFEWE--NYRKAWEAA
                          :   . .: * :* :  ::*           *          .:

ref|YP_001327980.1|    PFIRYMLNSLFVSVTVTVVALFFHSMAGYALARLRFPGRELIFLAIFSTLLVSLPVVIVP
ref|NP_436764.1|       PFIRYMVNSFLVSATVTVVALFFHTMAGYALARLRFPGREVMFLSIFSTFLVSLPVIIVP
RAAC01625              NMGRYLLNTVIVAVASVLGQLIFGSMAAYGFSRFNFKGKNVIFMLYLSTLMIPNIVTLIP
ref|ZP_01189621.1|     PFVRFFINTVIFAVGVTVISVFFDSMAAYAFARINFPGKKFLFILLATLMVPFQVTLIP
ref|NP_463711.1|       PMLRFLVNSVIVAVVTTLGQMLFCSMAAYAFARIPFWGRDKLFLLYLATMMVPAQVTMIP
ref|YP_001527658.1|    PFPRFFLNSAVMTVALTVSQTLLSAMAGYAFARLRFPGRNLLFFIVLGTLMIPFPVTLIP
                       : *:::*:  ..:.  .:    ::  :**.*.:::*: *  *:. :*:  :.*:::. * ::* ref|YP_001327980.1|    LFIIVRAMGMLNTYGGIIIPSIFNA-FGIFLLRQYYLSLPREIEEAAVMDGAGYWRIYWS
ref|NP_436764.1|       LFVIVKAMGMLNSYAGLIIPAIFNA-FGIFLLRQYYLSLPKEIEEAARIDGAGYWRIYWS
RAAC01625              LFIMMKYLGWINTYYALIAPAALGTPVGIFLLRQFFLTIPSEIEEAARMDGAGVIRVFVQ
ref|ZP_01189621.1|     VFKILFNLGWLDTFLALIIPRA-SNAFGIFLLRQFFITIPGELEDAARIDGCSEFRIYWN
ref|NP_463711.1|       QFILMKQFGWLDSYAGLIVPA-LFSVFGTFLLRQAFMGIPKELEEAAFMDGANHFTIFRK
ref|YP_001527658.1|    NFLTVNALGWVDTYQALIIPRAVSA-FAIFLFRQFFLSIPKELEEAARIDGASPFTIFWR
                        *   : :*  :::: .:*  *      .. **:**  ::  :*  *:*:** :**..    ::

ref|YP_001327980.1|    VILPLSKPILSALAILFFLANWNAFLWPLTVASDQKFWVVQVGIANFKSEYSAAWNYMLA
ref|NP_436764.1|       VILPLSRPIMSALAILFFLANWNSFLWPLTITSDPDLWVVQLGIANFKSQYSASWNYMMA
RAAC01625              IILPLSKPVLATLAIITFVSSWNNFLWPLIVTNTDSMKLVSVGIASFQFQVGAEWNYMMA
ref|ZP_01189621.1|     IILPLSKPALTTLAIFHFMYNWNDFLWPLVMTSSSTMRTLPVGLALFMGEHVIEYGLLMA
ref|NP_463711.1|       VILPLAKPTFATLGILTFMQSWNSYLWPLIVTSSQEMATLPLGLSLLQGRYGTNYGLMMA
ref|YP_001527658.1|    IVLPLSTPVLAASAIFSFLFAWNDFLWPLIITNSTEMRTVQVGLATFQGQYGIFWTLLCA
                       ::***: * :::  .*: *:     :**  ::.   :  : :*::  : .     :  : * ref|YP_001327980.1|    ASTIVAIPTLVLFLVFQRQIMDSIKTSGLK
ref|NP_436764.1|       ASTIVAIPTLILFVIFQRQIMDSLKTSGLK
RAAC01625              ASTIALLPLVILFLLFQRRIIESIQLTGLK
ref|ZP_01189621.1|     GATLALLPIVVAYLFAQRFFIKGIALTGLK
ref|NP_463711.1|       GVLISVIPILAVYLFAQKYFIQGMAMSGMK
ref|YP_001527658.1|    ATVIVTLPALLAFLAAQRRFIEGITSTGLK
                       .  :   :* :  ::   *:   ::..:  :*:*
```

FIG. 25A

```
ref|YP_832862.1|        ---------------------SGSSAESAKGE---------------LSYWLWDANQLP
ref|NP_733496.1|        -------------------LVSCGSSDEAGDGR------------TTVDYWLWDDLQLP
RAAC01626               MNRNGKKVVFTIPVVLTMLLVGCGTSTANKPGHQFSTSEGSASTQVVTLHYMLWDPNEEI
ref|NP_961026.1|        ----------------------------------------------------VWGDELAE
ref|YP_881303.1|        ----------------------------------------------------VWGDELAE
ref|YP_001624853.1|     ---------------------TATACSPA---ADNGGTASGDKVTVSVRLWDEQVQK
                                                                              :*.

ref|YP_832862.1|        AYQQCADDFQKANPDIKVKITQRGWDDYWSTLTNGFVGGTAPDVFTNHLGRYGELAANKQ
ref|NP_733496.1|        AYQECATAFEKANPDIAVRITQTAWNQYWQNLTTQLVSGEAPDVWTNQATYYPQFAAGNQ
RAAC01626               GYKQSIAVFEKLHPNIKVVIEQYPWSQYWQKLETEMAAGTAPDVFWDHVTYFPTFVTNGQ
ref|NP_961026.1|        AYRQSFAAFTRAHPDIEVHVNMVAYSTYFNTLRTDVAGGSADDIFWLSNAYLAAYADSGR
ref|YP_881303.1|        AYRQSFAAFTRAHPDIEVHVNMVAYSTYFNTLRTDVAGGSADDIFWLSNAYLAAYADSGR
ref|YP_001624853.1|     AYESSFKEFESQNPGIQVKTVLEPYTTYFNKLRTDVSAGNADDVFWISSSYFSPYADNGS
                         .*...   *   :*.* *        : *:..*  .. *  *  *::     .   .

ref|YP_832862.1|        LLPIDDAVKKDNVDLSAYNEGLADLWVGQDGKRYGLPKDWDT-IGLFYNKAMLSKAGVSE
ref|NP_733496.1|        LLDLQPYVERDGLDVSAYQAGLADTWVKDD-KRYGLPKDWDT-MAVVYNTDMLKRQGVDL
RAAC01626               LLNLTPYIKSSHVDLREYYPNLLKQYEYNG-NIYGLPKDWDT-IAIFYNKKLFEKDHVPF
ref|NP_961026.1|        LLNILDTLGTNAA--ADWERPVVEQFTRHG-QLWGVPQLTDAGIALYYNADLLGAAGIDP
ref|YP_881303.1|        LLNILDTLGTNAA--ADWERPVVEQFTRHG-QLWGVPQLTDAGIALYYNADLLGAAGIDP
ref|YP_001624853.1|     LLPIGSEFDSAKSG---WVPAAVSQYTRND-KLWGVPQLTDGGIGVYYNKDLVAKAGVSL
                        **  :    .         :    ..  :   :*:*:  *   :.: **  :.   :

ref|YP_832862.1|        EEMKNLTWNPQD--GGTYEKIIAHLTVDKNGKRGDEAGFDKNNVDVYGLGLNGGGDSSGQ
ref|NP_733496.1|        AALNDLTWNPAD--GGTLEQVIARATVDSEGRNGLDPAFDKDHVEVYGFLPEWADGAQGQ
RAAC01626               P-TNLTWNPRN--GGTLVKVAEEMTVDKNGKHPGQPGFNPNQIVQYGFMSYN----SNQ
ref|NP_961026.1|        AQLNGLRWDPAG--GDTLRPLLARLTVDADGNRGDTRGFDPGRVRQWGYNAAN----DPQ
ref|YP_881303.1|        AQLNSLRWNPAG--GDTLRPLLARLTVDADGNRGDTRGFDPGRVRQWGYNAAN----DPQ
ref|YP_001624853.1|     D---NLSWNPTDPAQDTFLKAAQKLTLDSAGRTADDPAFDANNIVQYGYNASQ----DLQ
                          .* *:*  .*     .  .  . *:* *.     .*:  ..:  :*      . * ref|YP_832862.1|        TEWSYLTNTTGWSHTDKNPWGTHYNYDDPKFQSSIDWFAGLVDKGY----MPKLETTVGA
ref|NP_733496.1|        NGWGNFAAANGFEYLDKNPWGTHYKFDDPRLAETVSWFRHLIDKGY----APRLDQQSSV
RAAC01626               SFYYNFLAEDGVKILDHN-FGTQVLMDTPQAIQTMQNLIDMIYKYH---VSPSGAEGANV
ref|NP_961026.1|        GIYLNYIGSAGGVF---Q-RGDEFAFDNPAAVSAFRYLVDLINRDH---VAPSAAD----
ref|YP_881303.1|        GIYLNYIGSAGGVF---Q-RGDEFAFDNPAAVSAFRYLVDLINRDH---VAPPAAD----
ref|YP_001624853.1|     AIYYNFIGQNGGAFQD----GEKFVFASPQSAQAFQYIVDLINKYH---VSPGAANS---
                           :        *    *. *   *   :.   : ::  :::       * ref|YP_832862.1|        AMADT---------FAAGKSAINAHGSWMIGQYTGYKGVEV----GIAPTPVGPEGKRA
ref|NP_733496.1|        ARTE----------LLIAGKGAMSLAGSFTVSSFTGPKVKQD---FGFAAMPVGPAG-RK
RAAC01626               VNSEGN-----AQQLFEEGKLAMYTDGDWVLTPVVKASNFPV----GIAPLPVGPIG-RV
ref|NP_961026.1|        TNDNGD----FSRNQFLAGRMALFQSGTYNLAPVARDARFRW----GVAMMPAGPVG-RV
ref|YP_881303.1|        TNDNGD----FSRNQFLAGRMALFQSGTYNLAPVARDARFRW----GVAMMPAGPVG-RV
ref|YP_001624853.1|     -NDNGD----FMRDQFIQGKISMFQSGTYNLANVTQGAKYPW----AIAPMPTGPAG-AV
                           :            *: ::  *  :    .           ..* *.** * ref|YP_832862.1|        SMFNGLADSIWAGTKKKDAAIKWVEYLASAPCQDVVASKAVVFPALKASSEKAAEAFKAK
ref|NP_733496.1|        SALNGLADSVWAGTDHKEEAWKWVKYLASADCQDRVAAHGVVFPALKSSTEKALAAHEAD
RAAC01626               SVMNGLSDAIYAHTKYPKQAWELVQWLASPQSERILASGGYVWPGIKSLAPLFAQAWTKK
ref|NP_961026.1|        SVTNGIAAAGNAATKHPAAVRQVLAWMGSRQGNEYLGRYGAAIPAVTSAQPVYFRYWASR
ref|YP_881303.1|        SVTNGIAAAGNAATKHPGAVRQVLAWMGSRQGNEYLGRYGAAIPAVTSAQPVYFGYWAAR
ref|YP_001624853.1|     SVVNNIIAAGNAKTAHKDATTKVLQWLGSTEGAKFIGAEGAADPAVTGAQDAYSSYWKAK
                        *  *.:   :   *   *      .   .   :  :  ::.*    :.  .  *.:..
```

FIG. 25B

```
ref|YP_832862.1|        GVDVTAFTEHVKN-GTTFLYPITDNTAKVKGIMEPAMDAVVSGKKPASSLTEANNQVND-
ref|NP_733496.1|        GDDVRAFTDAVGTKGVTFQLPVTEHGTEISPLVQDAIQSAILGQEDAADALES-------
RAAC01626               GVDVTPFLE--ESRGKTISFPITVNWGQAENAIDKEFDLMWLGKVPPSQALQTAVQQADA
ref|NP_961026.1|        GVDVTPFFA--VLNGPRIAAPGGAGFAAGNDALRPYFDEMFSGRGDVATTLRRAQAAANA
ref|YP_881303.1|        GVDVTPFFA--VLNGPRIAAPGGAGFAAGNDALRPYFDEMFSGRGDVATTLRRAQAAANA
ref|YP_001624853.1|     DVDVSVFAK--AAEGKTIQAPVGTNYGAAVNAWKPIFSEIFLGRTPVVSGLQQAQDAANK
                        . **  *       *   :  *                    :.    *:        .

ref|YP_832862.1|        ------
ref|NP_733496.1|        ------
RAAC01626               ALNGGQ
ref|NP_961026.1|        A-----
ref|YP_881303.1|        A-----
ref|YP_001624853.1|     AIAG--
```

FIG. 26

```
ref|ZP_01115262.1|      ------------------------------------------NIRSSLIGFGLIFPALVGF
ref|NP_624601.1|        ------------------------------------------RKAAWLFLAPALLGF
ref|NP_815894.1|        ---------------------------------------------SFIAPNFIGF
ref|YP_173820.1|        ---------------------------------------------KTLAFYLFISPWLIGF
RAAC01627               ------------------MRIMGIDASARLTRQVETNASYNIGRRLAPYAFIFPSFIGV
ref|NP_336858.1|        ---------------------------------------------RTALAYALLAPSLVGV
                                                                      ::  *  ::*.

ref|ZP_01115262.1|      SLFYAWPAIRAIAISFTDWNLLSEPTFVGFDNYIE-MVQDGQFWNGMKLSAYYVLLNIPL
ref|NP_624601.1|        ALFYAYPTVRGIYYSLTDYSLIATPDFVGGDNYSR-LIGDEQFWNALQVTGYYVLVNIVS
ref|NP_815894.1|        FLFTLIPVICSLILAFMSWDSFSTPEFVGMKNFTK-MIHDDTFWISLKQTFIYTIGVVPL
ref|YP_173820.1|        LALAAGPMIYSFYMSFTEWQVMGGAEWIGLENYERLFFHDPLFWKTMWNTFFYTFLGVPL
RAAC01627               LAFLLPVAVAVLIISLFNWNMLSPPKFVGLRNYLD-IFQDPLALHSMLVTVYYVLLNIPV
ref|NP_336858.1|        VAFLLLPILVVVWLSHRWDLLGPLRYVGLTNWRS-VLTDSGFADSLVVTAVFVAIVVPA
                         :    *  :   .  ::  :. :.   ::*  *:   ..  *     :  :  :.   :

ref|ZP_01115262.1|      QVVLGLFLAVAMDRLTRSL-FVKATVLLPYLLSNVLVAMVWLWMLDPILGIVNFFLDAIG
ref|NP_624601.1|        QTLLALVLATLMHRLTRSVAL-RAMLLVPWLVPNVTVGLLWMWLLDTNLGLVNHVLNSMG
ref|NP_815894.1|        TLICSLGLAILLNRKIRGMKFFRTAFFFPYVTSLVAIAVVWNMLFHPTMGPINQFLKLFI
ref|YP_173820.1|        GLAFGYLLAVLLNQKVKFMGVFRTIFYLPSIVPAVASSLLWVLIFQPEFGLANALLDSVG
RAAC01627               QTVLAILLALLLNRRLPGMGMFRAFFVLPWLAMPVAISVVWNLIFDPTNGVLNDVLTAVG
ref|NP_336858.1|        QTVLGLLAASLLARRLPGTGLFRTLYVLPWICAPLAIAVMWRWILAPTDGAISTVLG---
                          .  *  : :     .  ::    .*  :     :  .::*  ::    *   . .* ref|ZP_01115262.1|      IGRQSFLGDPEQALISVAAINIWRHMGLCAMLFLAGLQTIPRYLYEAASLEGASEWKMFR
ref|NP_624601.1|        MGTTGFFTSPDWAMPSVAAVNTWAYTGYTALLLYAGMLQVPQYLYESASLDGAGEWRMFT
ref|NP_815894.1|        ENPPGWTSSSTWALPAIIIVSVWRFMGYYMILYLAGLQSVPRELYEAASMDGAGKWNQFL
ref|YP_173820.1|        LPTSRWLLSESMVKPALIIMSLWG-VGGGMIYLAGLQGVPPSLYEAAEIDGAGKWRKFW
RAAC01627               LHPQQWLSSPVEALPCVAAVNIWQWTGYNMLFFLAGLQSIPSHLYEAANIDGAGRLRKFF
ref|NP_336858.1|        -HRIEWLTDPGLALPVVSAVVVWTNVGYVSLFFLAGLMAIPQDIHNAARTDGASAWQRFW
                           :     :    :     *     *    ::   **:   :*   ::::*   :**.   . * ref|ZP_01115262.1|      MITLPLLRPVMVFVLVTSVTGSFQIFDTIAVTTMGGPMDSTRVIVYYIIQNAFSFYKMGY
ref|NP_624601.1|        RITLPLLRPVLSLVLVVSLIGSFQIFDTIAVTTKGGPVSATRVIYYYIYEQAFTNFHMGY
ref|NP_815894.1|        NVTLPSLRPTTFFVTIMLVINCFKVFDLVQVMTGGGPGRATNVLVYEIYNEAFVKFNFGY
ref|YP_173820.1|        HITIPMTSHVIFFNLIMGVIGSFQVFTQAYVMSGGGPNYASLFYVLYLYQNAFEFFNMGY
RAAC01627               SITLPLLRPTLLFVLITSVIGSFQVFDTVYVMTQGGPTATNVNYYIFQQGFQFFHMGY
ref|NP_336858.1|        RITLPMLRPTMFFVLVTGIISAAQVFDTVYALTGGGPQGSTDLVAHRIYAEAF-------
                         :*:*       . : :   :  .. ::*    . : ***  ::  .     :  :.* ref|ZP_01115262.1|      --------------------------------
ref|NP_624601.1|        --------------------------------
ref|NP_815894.1|        --------------------------------
ref|YP_173820.1|        ASALAWVLFVIVLIFTLLQFKFFGKKVYYE--
RAAC01627               AAALSVILFVVILLVTLIQFRFVGKGATYDMS
ref|NP_336858.1|        --------------------------------
```

FIG. 27A

```
ref|ZP_01172341.1|    ------------------------------------------------------------
ref|YP_001124945.1|   ------------------------------------------------------------
ref|YP_001665505.1|   ------------------------------------------------------------
ref|YP_001663811.1|   ------------------------------------------------------------
ref|NP_622450.1|      ------------------------------------------------------------
RAAC01754             MTRSHSRQAVGVTERDGGRFALLVEAPPAAAPQTRSWADTPLGFGGGRPPWQRVLGEVRP ref|ZP_01172341.1|    ------------------------------------------------------------
ref|YP_001124945.1|   ------------------------------------------------------------
ref|YP_001665505.1|   ------------------------------------------------------------
ref|YP_001663811.1|   ------------------------------------------------------------
ref|NP_622450.1|      ------------------------------------------------------------
RAAC01754             HPRAPLRARTPVGPMGQVVRATNARNPCSLLRSQNVFGYIDADSRVVGSGCRKRFGCAGG ref|ZP_01172341.1|    ----------TIKDIAKAAGVSVTTVSRALNGYSDVNEKTREKIMSVAKELNYSPNTLAR
ref|YP_001124945.1|   ----------TIKDIAKAAGVSITTVSRALNGYSDVNENTRQKIIDIARQLNYIPNTLAR
ref|YP_001665505.1|   -------MAVTIKDIAKYAGVSVTTVSRALNGYPDVSEETRERIKKIAEQLNYTPNSIAR
ref|YP_001663811.1|   -------MAVTIKDIAKYAGVSVTTVSRALNGYPDVSEETRERIKKIAEQLNYTPNSIAR
ref|NP_622450.1|      -------MAVTIKDIAKYAGVSVTTVSRALNGYPDVSEETRAKIKKIAEELNYTPNSIAR
RAAC01754             SQKGFAAMRVTIRDVARAAGVSVTTVSRALNGAADVGEETRQRVIEVAKQLNYRPSHVAR
                             **:*:*: ****:******** .**.*:**  ::  .:*.:*** *. :**

ref|ZP_01172341.1|    SLVMNKSKTIGLLVSGLNKGSVKDNFTFEVLSGVNDYVSETDYDLVLFSTTSIKQREKTY
ref|YP_001124945.1|   GLVMNKSKTIGLLVSGLTKESAKDNFTFEVLAGVNEYVSEVDYDMVLFSTTSTKQREKTY
ref|YP_001665505.1|   GLVTNKTHTVGLIVSELIKPGAYHPFFLEVLAGIKAGLKKDKYDLILFTVDPESQDATSY
ref|YP_001663811.1|   GLVTNKTHTVGLIVSELIKPGAYHPFFLEVLAGIKAGLKKDKYDLILFTVDPESQDATSY
ref|NP_622450.1|      GLVTNKTQTIGMVVSELIKPGVYHPFFLEVLAGIKAGLKKDRYDLILFTVDPESQDATSY
RAAC01754             SLVLRKSQNIGLLVSDFRKG--SHHFLYDVLVGVHDTLAEYGYDVTLVSTDTARQQLVSY
                      .**  .*::..:*:*  :     . *  :** *::    : **: *.:. .  *   :* ref|ZP_01172341.1|    TQLCRERRVDGVIMQGIRTDDPYLQEVVESDIPCVLIDIPIETDTAGYITTDNKLGAKKA
ref|YP_001124945.1|   TQLCRERRVDGAILQGIRTDDPYLHEVVESDIPCVLIDIPIESRTVGYVTTDNVLGAKKA
ref|YP_001665505.1|   EKLCNDRKVEGAIVEGLRLSDPYIEEIKRTQIPTVLIDIPILTDKVGYVSSDNVQAAFEA
ref|YP_001663811.1|   EKLCNDRKVEGAIVEGLRLSDPYIEEIKRTQIPTVLIDIPILTDKVGYVSSDNVQAAFEA
ref|NP_622450.1|      EKLCNDRKVEGAIVEGLRLSDPYIEEIKGTQIPTVLIDIPILTDKVGYVSSDNVQAAFEA
RAAC01754             VDFCRARGLDGVIVMGIRLDDPYVEEVVESTLPSVVIDLPLLSRHCGYVMTDNVNGARYA
                       .:*.  * ::*.*: *:*  ,***:.*:    :* *:**:*:  :  : :  .* * ref|ZP_01172341.1|    IEHLIRLGHRNIAMINGHEYAFVSQQRLQGFEEAMQGAGLSLNKEWIVNGEFNEEAAESA
ref|YP_001124945.1|   VRHLIELGHKRIAMINGYEYAFVSEQRLKGFKEALLEAGLPVREYWIANGAFREEIAEQE
ref|YP_001665505.1|   TSYLIKLGHRNIGFINGHGDAAVSFERLEGYKKALEKNNIPYKEEYVVFDDFTQEGGYNS
ref|YP_001663811.1|   TSYLIKLGHRNIGFINGHNDAAVSFERLEGYKKALEKNNIPYKEEYVVFDDFTQEGGYNS
ref|NP_622450.1|      TSYLIKLGHKNIGFINGHKDAAVSFERLEGYKKALEKNDIPYREEYVIFADFTQEGGYNA
RAAC01754             VRHLVSRGCRRIGFVNGAAHAAVSRERLRGFEDAVRQYVGGFDERLVVYGDFTLEGGQRA
                       :*:  *  :.*.::**    * **  :**  * **.*::.*:     :   *  *  .

ref|ZP_01172341.1|    AVKLLKEHHEISAIFCASDLMALGVMKAAKRLNLQVPEELSVVGYDDIMLSSYVSPPLTT
ref|YP_001124945.1|   ALRLLQHYPEITAFFCASDLMALGVIKAVKRLGKRVPDDVAVIGYDDIILASYSSPSLST
ref|YP_001665505.1|   FKTLVFEHPEITAVFHASDLMAIGSFKAAKDLGMKVPDDISIVGFDDIELASLITPGLTT
ref|YP_001663811.1|   FKTLVFEHPEITAVFHASDLMAIGSFKAAKDLGMKVPDDISIVGFDDIELASLITPGLTT
ref|NP_622450.1|      FKTLIFEHPEITAIFHASDLMAMGSYRAAKDLGMRIPEDISLVGFDDIELASLITPALTT
RAAC01754             LAELLAKAPDVDGVFFASDLMAIGGIQHCKAMGIRIPDDLAVVGFDDIDLARFVTPALTT
                       *:  .  ::  ..* *******:*   *  *  ::*::::::.*:*** *:   :* *:*
```

FIG. 27B

```
ref|ZP_01172341.1|      IAQNKFLMGYEAAKMLINTLEEKEEPHVVTLDTELKIRET-
ref|YP_001124945.1|     IAQDKFAMGYEAAKLLIAMLEGKADSHIKILQTELKARES-
ref|YP_001665505.1|     IRQDTFKMGYNAAKHLLSII-KGEKPQHILIPHKLVIRDSA
ref|YP_001663811.1|     IRQDTFKMGYNAAKHLLSII-KGEKPQHILIPHKLVIRDSA
ref|NP_622450.1|        IRQDTFKMGYTAAKHLLAII-RGEKPQHIVIPHKLVVRDSA
RAAC01754               VAQPRYEMGCEAAKMLVHMLQKGEMPSGTLLPPQLVVRETA
                        : *  : **  *** *:  :       .   :  :*  *::
```

FIG. 28A

```
ref|YP_001665503.1|   ---------------------------------TSSANETNTQKQETAKPVT
ref|NP_622452.1|      ---------------------------------------------TSKPVT
ref|YP_001179269.1|   ---------------------------------------------AASKIT
RAAC01756             METSGVKPIGWEVERKMRKPFLGIAGAAVVAMGAVTACGQAQSAPSNQANVGSASAAPIH
ref|YP_001124947.1|   ----------------------------------------SEQANGGNKQGEKVE
ref|NP_244557.1|      ---------------------------------CNFADEEPSSEPTEGGNTDGEVVE
                                                                        .  :

ref|YP_001665503.1|   IKLGMWSSSPAEKKIVDDQIAKFKEKYPNIDVQIETIVGDYMQKLQTELASNTAPDIFYL
ref|NP_622452.1|      IKLGMWSSSPAEKKIVDDQIAKFKEKYPNIDVQIETIVGDYMQKLQTELASNTAPDIFYL
ref|YP_001179269.1|   LKLGAWASSPAEKKIVQNQIAAFKKLYPNVDVRITEIVGDYNQKIQLLMASKTEPDIFYM
RAAC01756             LTLGMWASSPAEKQLVERQIALFEKENPNIKVSIQVITGNYLQALQPMLAAHDAPDIFYV
ref|YP_001124947.1|   VTLAGWGGNPSEQKLLQQTIDDFEKKHPDIKVKYEVIADQYMDVIKTRLSGGQGPDVFYL
ref|NP_244557.1|      LTLTGWQSSPTEQRYFEETVATFEEQNPDIKVNINTIPDQYMDVLRTRLIGGEGPDVFFL
                      :.*    *  ..*:*::  .:     :    *::  *::.*     *  .:*  : ::   :  .    **:*::

ref|YP_001665503.1|   DSMPAPQLMSSGVLEPLDDYIKKYNVDVNDFEPALLSAFQ-WDGKTYGLPKDFNTLALFY
ref|NP_622452.1|      DSMPAPQLMSSGVLEPLDEYIKKYNVDVNDFEPALLSAFQ-WEGKTYGLPKDYNTLVLFY
ref|YP_001179269.1|   DSMPAWQYIAKGVLEPLDYWMKKYNVKTIGYESSLLQPFI-YKGKVYGLPKDYNTLVLFY
RAAC01756             DSSYAPTLEASGAIMPLDSFIKQDHVDLSDFQKNLLDAFT-WQGHIYGLPKDMNTMALEY
ref|YP_001124947.1|   DAFEAPALIETGALEPLDEYVT-DEFDIDDFEKPMLDAFKGEDGKIYGFPKDYSTLALFY
ref|NP_244557.1|      DAFEAPGLIETGAVEPLDEYIT-DEFDLADFEQPLLEAFE-RNGVLYGLPKDTSTLALFY
                      *:  *       .*.:  ***  ::.   ...   .::  :*..*    .*  :* .*:.* * ref|YP_001665503.1|   NKDMFKAAGINEPPKTWEELRDVAKKLTK-DGVKGLVLSADLARFDAFINQNGGSVYQ--
ref|NP_622452.1|      NKDMFKEAGINEPPKTWEELRETAKKLTK-NGVKGIVLSADLARFDAFINQNDGSVYK--
ref|YP_001179269.1|   NKEMFKQAGLTRPPRTWQELKDYAKKLTT-GKVVGLTMNLELARIQPFAYQNGGKVFD--
RAAC01756             NPALLAKAGIQSPPKTFAQFDQDAAKLKA-KGIVPLDMPIDVARYYPFIVDMGGSYYNKA
ref|YP_001124947.1|   NKKMLEEAGVEVP-KTWDELREAAKKLTKGKDVYGFGVAPELARLYYIAESKGGKVVTD-
ref|NP_244557.1|      NIDMLEEAGFDGPPETWEELEEMAIALTN-DDEYGFGVVTDLARLMFIAQSNGGQI--AT
                      *  ::  **.    *  .*:  ::    :  *   *.     : :    ::**    :  . .*.

ref|YP_001665503.1|   DGKVTLNLPENAQALDFYVSLITKDKVADTPQNMGEGWNGDAFAAKKAAMAIEGGWMIPF
ref|NP_622452.1|      DGKVTLNLPQNAEALDFYVGLIIRDKVADTPQNMGEGWNGDAFAAKKAAMAIEGGWMIPF
ref|YP_001179269.1|   GTKPVFTDPKALEGFKFALDLFKEG-ICKTPKDLGAGWVGDAFADKKAMMTIEGGWMIPF
RAAC01756             TNQATFTNKANVAGLTWFMKEMESG-NFVTPQDQGGSWAGVFPAEGKAAMALEGAWIVPF
ref|YP_001124947.1|   -NKASFADSKVVDALQPIVDMHLKDKTAAQPNEVGATWGGGEMFGQGKAAMVIEGNWAIPF
ref|NP_244557.1|      DNQATFADPRVVEALQPIVDMRNVDGSAVEPSEVGADWGGEMFGLERVAMVIEGNWTVPF
                        :       .:   :       *.:   *     * *   *.   :.**.:** *  :**

ref|YP_001665503.1|   LKEK-APDLNYGIAELPA-GKQKSTMAFTVAYVMNKNSKHKDEAFKLIEFLTGKEGQQFV
ref|NP_622452.1|      LKEK-APDLNYGIAELPA-GKKKSTMAFTVAYVMNKNSKHKDEAFKLIEFLTGKEGQQFV
ref|YP_001179269.1|   LNERKIPKDSYGIAELPAGPAGKSTMAFTVAYVMSKNSKHKPEAFKLIRFLTGEGGQKFV
RAAC01756             MQQT-APKMKYGIADFPSLNGHDANMLFTVAYEMSKYAKNPDAAAKLLFFMTGKEALKMT
ref|YP_001124947.1|   LQDT-FPNLEFGTAELPTINGKKATMAYTVAYVMNKDSQKKEAAWKLISYLTGKEGMKTW
ref|NP_244557.1|      LDEN-FEDVNYGVAEVPTINGNEGTMAYTVSYVMNRNSEHKEEAWRLIEFLTGKEGMELW
                      : .:     .  ..:* *:.*:    ...* :**:* *.: :::    *  :*: ::**:  . :

ref|YP_001665503.1|   VDSGLALPSRKSMQEGF-KEKYPERAAFVDGASYAVPWQFGLYGTKVVDAANKACEALIM
ref|NP_622452.1|      VDSGLALPSRKSMEANF-KEKYPERAPFIDGASYAVPWQFGLYGTKLVDAANKACEALIM
ref|YP_001179269.1|   VEAGLALPSLKSAGVNF-AKTYPERKALVDGAKYAQVYFYGLDGTKVVDVFNKAFEDYVI
RAAC01756             ADSGLAIPSRTSEQGEF-LKKYPSYKGFVDGLKGAIPYQFGTLGQNFLDAINNATQQGIL
ref|YP_001124947.1|   TSKGYALPTRKSVAAELGFDKDPLRAALVAGAPYATVWQNGTNLPIIVNNFNNQFVSAFL
ref|NP_244557.1|      TSSGLTLPTRASVSEKLDYADDPIYGPFIAGQSYATVWADDTNLPIVNNNFQNQFTSAFL
                      .. * ::*: *     :       *      ::  *     *  : .       . : ::        .:
```

FIG. 28B

```
ref|YP_001665503.1|     KQISSAQQALDNAQK--------
ref|NP_622452.1|        KQIGSAQEALDNAQK--------
ref|YP_001179269.1|     GKK--------------------
RAAC01756               KKE-SAQQVLSQAQQTLASQMND
ref|YP_001124947.1|     GER-PLADALKEAEKTANSEI--
ref|NP_244557.1|        GQR-DLAEALKEAEEVANSEI--
                                :
```

FIG. 29

```
ref|YP_001665502.1|    ----------------------EALSGYAFVLPFIASISIFLIGPLIYAFIISFKEFS
ref|YP_001663808.1|    ----------------------EALSGYAFALPFIASISIFLIGPLIYAFIISFKEFS
ref|NP_622453.1|       ----------------------IYEALTGYIFVLPFIASISIFLIGPLIYAFIISFKEFS
ref|YP_001179270.1|    ----------------------VQEYFTAFVMLLPYIISFFMFFAYPLAKAFIISFQEFS
RAAC01757              MSVANSAAERVTGRGRRIRWNVVEQALAGYLFILPAIVELAVFLLGPIVYAFVISFKHFS
ref|ZP_01172344.1|     ----------------------LREAGQGYLFMSPTLFVLLTFILGPIIYAIFLAFNKVQ
                                              :   .: :  * :  :  *:  *:  *:.::*:...

ref|YP_001665502.1|    FLNPEASRWIGFANYIKLFSDPTFKRALLNTTLYSLGVVPTQLVIALILALIVNSDIKGK
ref|YP_001663808.1|    FLNPEASRWVGFANYTKLFSDPTFKRALLNTTLYSLGVVPTQLIIALILALIVNSDIKGK
ref|NP_622453.1|       FLNPAASKWVGLANYINLFSDPTFKKALLNTTLYSLGVVPTQLIIALILALIVNSDIKGK
ref|YP_001179270.1|    FLGDIPPKFVGLLNYKEALTNKMFLDSIVNTFYYSILVVPTQLIIALILAVIVNDKVKFK
RAAC01757              YLDPLNSHFVGFLNYIHLFEDPVFLRALWNTTVYALVVVPVQTAIAMMLAVIVN-RIRGK
ref|ZP_01172344.1|     LLGAVNYDFVGFQNFVRLVDDSRAHIALWNTAKYVFIVVPVQTFLALVLAASLNAGLKGE
                        *.       ::*: *:   . :       ::  ** * :  ***.*   :*::**   :*   :: :

ref|YP_001665502.1|    TFFRVAYYIPTVTSTVAVSVIFLYLFKADGLVNALL----AKFGIQGPTWFNDVRFALPS
ref|YP_001663808.1|    TFFRVAYYIPTVTSTVAVSVIFLYLFKADGLVNALL----AKFGIQGPTWFNDVRFALPS
ref|NP_622453.1|       TFFRVAYYIPTITSMVAVSVIFLYLFKTDGLVNMIL----AKFGIQGPTWFNDVRFALPS
ref|YP_001179270.1|    DFFRTTYYLPTVTSPVAVSIIFLFLYKTDGLVNQILS---HI-GITPRNWFNEPSFVMPA
RAAC01757              TIFRVIYYLPSITSTVGVAVIFSFLFQPNGLLNRLLW---ILFHIQGPDYFNSPIFAFPA
ref|ZP_01172344.1|     KFFRIIYFLPTLTSSAVLTLIFMWMYNQNGLINKI----FETVGLPTYNWIGDPSIALNS
                       :**  *::*::**  . :::**  ::::  :**:*  :        :     :: ..  :.: :

ref|YP_001665502.1|    IMMMAIWSSVGNYMVIFLAGLQDIPSELYEAAEVDGANKFQRFFKITLPMLRPIVFFNLV
ref|YP_001663808.1|    IMMMAIWSSVGNYMVIFLAGLQDIPSELYEAAEVDGANKFQRFFKITLPMLRPIVFFNLV
ref|NP_622453.1|       IMMMAVWSSVGNYMVIFLAGLQDIPAELYEAAEVDGANKLQKFFNITLPMLRPVVFFNLV
ref|YP_001179270.1|    IVSVAVWGSVGFYMVTFLSGLSTIPDQLYEAAEVEGAGEFTKLIKITIPLLKPMIFFNTV
RAAC01757              IMAVAVWTTAGQFMVIYLAALQEIPEELYEAAAIDGAEGFAMLRYITIPSLRRTTFLVVV
ref|ZP_01172344.1|     IMIMNIWSTAPFFMVIYLAALQGIPDSLYEAADLDGANAIQKFFFITVPNLRPVTSFVVI
                       *:  : :* :.   :** **:.*. **  ***** ::**    :   : **:* *:     :  :

ref|YP_001665502.1|    MSLIGTFQVFDQAYVVSQGTGGPLDATMTVVLDIYRTGFRDFN-MGYASAMAFVLFVIIL
ref|YP_001663808.1|    MSLIGTFQVFDQAYVVSQGTGGPLDATMTVVLNIYRTGFRDFN-MGYASAMAFVLFVIIL
ref|NP_622453.1|       ISLIGTFQVFDQAYVVSRGTGGPLDATMTMVLYIYRTGFRDFN-MGYASAMAFVLFVIIL
ref|YP_001179270.1|    VSFISTLQMFDLSYIIGGSDGGPMGKAMTVVVMIYRTAFKEFN-MGYASAMAFIVFGIIF
RAAC01757              LGMIGAFQVFDLVYVISSASSLPQQYTMTVVLDLFEKGFRTMQ-MGYASAMGFVLFAIIL
ref|ZP_01172344.1|     MGIIGTFQLFDQSYIFSGGSGGPNNSTLTVVLLIYQYAFKNLGTMGYAAALAFALAVIIL
                       :.:*.::*:**  *:..    .  *    ::*:*:  ::.  .*:  :  **  *:*:.*  :  **:

ref|YP_001665502.1|    ILTLIQR--------
ref|YP_001663808.1|    ILTLIQR--------
ref|NP_622453.1|       ILTLIQRMFFKEE--
ref|YP_001179270.1|    ILTLVQRKFFGEE--
RAAC01757              VLTLIQQLWLGREDA
ref|ZP_01172344.1|     AATLLQRRFSKEEN-
                        **:*:
```

FIG. 30

```
ref|YP_001665501.1|        ------------------YTVVVGYAVITLGPFIWSIITSLKPTSELNT---FAVNIKH
ref|YP_001663807.1|        ------------------YTVVVGYAVITLGPFIWSIITSLKPTSELNT---FVVNIKH
ref|NP_622454.1|           ------------------YMVLIGYAAITLGPFIWSIITSLKPTSELNT---FAVNIKH
RAAC01758                  MRMATSAPSPSWRRAGLWMYVIAVIYAAISLVPFLWSIYTSVKPTSEVFQ---LFVPWRT
ref|YP_001179271.1|        ------------------YSICILWTLVTLIPYLIAVITSLKPVEDVTK---FSIDFSK
ref|YP_001124949.1|        ------------------LYVVLVMYAIITLIPFLWALSSSFKTLEEIVSGTMSFVP-KQ
                                             *  :  :  ::  ::* *::  :: :*.*.  .::          :

ref|YP_001665501.1|        LTLDNYKMIITKFP-FLRWFINSAIVAVIVTLGNILFNSMAGYALARINFPGRNLLFMVV
ref|YP_001663807.1|        LTLDNYKMIITKFP-FLRWFINSAIVAAIVTFGNMLFNSMAGYALARINFPGRNLLFMVV
ref|NP_622454.1|           LTLDNYKMIITKFP-FLRWFINSAIVAAIVTFGNMLFNSMAGYALARINFPGRNFLFLLV
RAAC01758                  LTLSSYTSILQNFP-FGRWFLNSAIVAFIVTVGNLVVNTFAGYAFARLRFPGRGFLFYVF
ref|YP_001179271.1|        LTFDSYRYITHEFP-FLRWLFNSFVVAVAVTTGNILFNSMAAYALARLDFPFKKVVFYVI
ref|YP_001124949.1|        FTLDNYKQIFVEQDLFPRWLLNSVIIAVAVTILNLLFNSMAGYALARLQFPGRKPLFLII
                            :*:..*  *   :  * **::**  ::  **  *::.*::*.**:**:  **   :*  :.

ref|YP_001665501.1|        LALMMVPGQVVMVPTYILLSKLGWVNTYMGLTIPFLTSNFGIFLMRQFFLSLPKELEEAA
ref|YP_001663807.1|        LALMMVPGQVVMVPTYILLSKLGWVNTYMGLTIPFLTSNFGIFLMRQFFLSLPKELEEAA
ref|NP_622454.1|           LALMMIPGQVVMVPTYILLSKLGWVNTYMGLTIPFLTSNFGIFLMRQFFLTIPRELEEAA
RAAC01758                  LGVMMIPGQVVLVPIYMLLARLGWIDTYVGLTVPFLLSSTMVFLSRQFFLGIPKELEEAA
ref|YP_001179271.1|        IGTMMIPGQVLLIPIYLILNRLGWIDSYKGLIIPWLVSAFYIFFMRQYFLTIPKDLEEAA
ref|YP_001124949.1|        LAVLMIPAQVTMIPNYLILKQLGWLNSYQGMIVPTMINATFIFMMRQFFINFPKELEEAA
                           :.  :*:*.**  ::* *::*  :***:::*  *: :*   :  .*:  **:*:  :*::***** ref|YP_001665501.1|        TIDGLSRFGIFFKIVLPLSKPALATQFIFMFTGNWNSFLWPSLLTSSDDMYTLPVGLNSF
ref|YP_001663807.1|        TIDGLSRFGIFFKIVLPLSKPALATQFIFMFTGNWNSFLWPSLLTSSDDMYTLPVGLNSF
ref|NP_622454.1|           TIDGMSRFGIFFKIVLPLAKPALATQFIFMFTGNWNSFLWPSLLTSSDDMYTLPVGLNSF
RAAC01758                  RIDGIGYFGMFFRIMLPLARPLLAAQTILTFQGNWNSFLWPLLIGQTTNMYTLPVGLNSF
ref|YP_001179271.1|        LIDGLSRFGIFFKIFLPLSLPALATQAIFIFVGNWNSFMWPSIIASSEDLYTLPVGLNSF
ref|YP_001124949.1|        ELDGLGRFGIFFRIVLPLARPALAAQAIFVFMGSWNDFMRPLIILSDPQLFTLPLGLNSF
                            ::. :**:*.*** : *  **:*  *:   * *.**.*: *  ::  . :::*:*** ref|YP_001665501.1|        YGQYYQFWNQVMAGAILLTLPTILIFLIFQRYFVKGISTTGLK-
ref|YP_001663807.1|        YGQYYQFWNQVMAGAILLTLPTILIFLIFQRYFVKGISTTGLK-
ref|NP_622454.1|           YGQYYQFWNQVMAGAILLTLPTIVIFLIFQRYFVRGIATTGLK-
RAAC01758                  YGQYNAYWNSVMAGMVLLTVPMMVVFIIFQRQFIQGVSQAGLKG
ref|YP_001179271.1|        YGQYYQFWNQVLAGAILLSLPTIIVFVLFQKYFVKGIVTSGLK-
ref|YP_001124949.1|        KGQYISYWNYIMAASMVFTLPVLVIYAFFNRYFIKGISFTGGK-
                           ***  :**  ::*.  ::*.  :::::*  ::::  :*::  *:  :* *
```

FIG. 31A

```
ref|YP_001619074.1|  ------------------------------------------------------------M
ref|YP_001613999.1|  ------------------------------------------------------------V
ref|YP_001618197.1|  -------------------------------------------------------------
ref|YP_001614945.1|  -------------------------------------------------------------
ref|YP_001471644.1|  -------------------------------------------------------------
RAAC01989            MQKGERNMKRSKSNRGWVAAAVGLAVVGVAGCGAANTSANGASHSASASPEAASASSSSV ref|YP_001619074.1|  VTISREQQASWVRSFNPLLAEGSVRFP-TLAGIYEPMLIFNTMKGEYTPWLATKYAWSDG
ref|YP_001613999.1|  VTIAREQQATWVRNFNPLLPEGSARFP-TVAGIYEPMLVYNTMRSDYTPWLATGYAWSDA
ref|YP_001618197.1|  VTISREQQASWVRNFNPLLGEGATRFP-TVAGIYEPMIVYNTMKGEYVPWLATKYEWSDA
ref|YP_001614945.1|  LTVSIEQQASWVRNFNPLLAPGNVRWP-TVAGIYEPLLVYNTMKGEFTPWLASKYEWGNG
ref|YP_001471644.1|  LTMIISVTGAHQRNFNPYFAGGTGYAA--CGFIYETLIYSNNFTGEIIPWLAVDYEWSND
RAAC01989            LTVAPNVTGTFSDNFNP-FSTNSMPGT--LGNIYETLFYFDNTTGKQFNLLGTSFHFSNG
                     :*:    .  .:   .***   :  .       ***.::    :.   ..    *. : :.:

ref|YP_001619074.1|  NKKLTFTTRSGVQWSDGQAFSAKDVVFTFELLKKHAALDLSGVWKF-VESVKATDDATVE
ref|YP_001613999.1|  NKKLTFTTRSGVKWSDGQAFTARDVAFTFALLKKHAALDLAGVWRF-LGAVTAIDDTTVE
ref|YP_001618197.1|  NKKLTFTTRTEVKWSDGQPFSAKDVAFTFGLLKKFPALDLTGVWKL-VDSVEAKNDTTVE
ref|YP_001614945.1|  NKTLTVTTRPGVKWSDGQPFTAKDVAFTFGLLKKHVALDLQGVWKW-LTSVEAKSDSTVE
ref|YP_001471644.1|  YRSIVFNLRKNVTWSDGKPFTADDVVFTFEMLRKFPSLDTQGIWSSGLESVEKIDSYTVR
RAAC01989            GKILTVSLRKNAVWTDGVPFTAQDVVFTFEDLKKYPDADTNGVWQQ-LKSVQADGKYTVV
                     :  :... *     . *:**  .*:* **.*** *:*.   *   *:*    :.*   .. **

ref|YP_001619074.1|  FALKRPYVPGLS--YIGHQPIVPEHKWKDVADP--VTYANENPVATGPFT-EIKTFQNQV
ref|YP_001613999.1|  FTLRRPYVPGLS--YIGHQPIVPEHVWKDVVDP--VTFANENPVATGPFT-EVKVFQNQV
ref|YP_001618197.1|  FVFKEAFVPGLT--YIGHQPIVPEHKWKDVADP--VTFTNENPVATGPFT-EVKTFQNQI
ref|YP_001614945.1|  FTLTRPYVP--GLVFLGHQPIVPEHKWKDVADP--VTYTNENPVATGPFT-EVKTFQNQI
ref|YP_001471644.1|  LNFSKLNTLII--YNIAGVYMVPKHLWEKLDDP--SKFTNENPVGTGAYVLENFT--DQV
RAAC01989            FQFAQPNIPFAEQYVLGGTYIVPAHQWKSLGDPAKAKITHLNAIGTGPFKLSSFTTQDYQ
                     :  :  .   :. :**  *  *::.: **      . ::  *.:.**.:      .   .

ref|YP_001619074.1|  YELGRNPNYWQKGKPAVDGLRFPAYPGNDQVNLAIINGEVDWAGAFVPEIEKVYVAKDPA
ref|YP_001613999.1|  YELGKNPRYWQEGKPAVDGLRFPAYPSNDQVTLALVNGEIDWAGAFVPDIERVFVAKDPA
ref|YP_001618197.1|  YELGKNPNYWQKGKPAVEGLRFPAYPGNDQANLALINGEVDWAGNFVPDIDKTYVAKDPE
ref|YP_001614945.1|  YELGRNPNYWQQGKPAIKGLRFPAYPGNDQANLALLNGEVDWAGNFVPEIEKVYVGKDPA
ref|YP_001471644.1|  FTLKRVDYWQAEKVKVDRIRIPAFNGNEPAQLAVANGELDWAGINYPRIEN----VQNK
RAAC01989            FTANPRY-YGGAPEVKT--LNYPAFASNSSADLALASGQIQYAGINIPNVEKTFVAADPA
                     :   .   *   :       :. **:.*.*. . **:  .*::::**: *  ::.   :

ref|YP_001619074.1|  NHHYWFPLVGGMATLYPNSTKKPFDDVRVRKAISMGIDRAQIVKIASNDYTQPADATGLD
ref|YP_001613999.1|  HHHYWFPLVGGTATLYPNATKKPFDDVRVRKAISMAIDRDQIVKLAADNYTHGADATGLD
ref|YP_001618197.1|  NNHYWFPLVGGTVTLYPNATKKPFNDIKLRKAISMAIDRAQIAKVAVNGYTVGADGTGLD
ref|YP_001614945.1|  NHHYWFPLVGSTVFVYTNTTKKPLDDARVRKAISMSLDREQIVKVAMNNYTRPADATAL-
ref|YP_001471644.1|  DIKYWFPEG-NPVFLFFNLERDPFKDPAFRKAIARAVNTDELVKIGMTNYAVKANPV-LI
RAAC01989            HNHYLFPPN-ESVELYPNLHNSLLAMLPVREAISLAIDRDALSKIGETGYEKPAVPTSLV
                     . :* **     . :: *   ..  :   .*:**:  .::    : *:.    *      * . * ref|YP_001619074.1|  -DSYERWRNPKAVAAGDWV-KLDVARAKQLLDEAGYAPGPDGIRV-KDGKPMRFEINVVT
ref|YP_001613999.1|  -DSYERFRSEKAVEAGDWV-KFDPQRANQILDEAGYPRGADGIRT-RLGKPMHFEINVVS
ref|YP_001618197.1|  -DAYGRWRSDKAAAAGDWT-TFDVAKANALLDEAGYAKGADGIRA-KDGKPLKFDINVVT
ref|YP_001614945.1|  SDAHERWRSQKTVEAGDWV-KFNVAKANQILDEAGYAKGADGIRV-KDGKPLRFDLNVVT
ref|YP_001471644.1|  KSGYSYLIDENLKDK-WYSFDIQQAKSE--LASLGFRAGKDGILVGADGKRLSYELIVPA
RAAC01989            LPPQSSWLDPSLPAS-DRAFAVNDAKAVQILQKAGFRKDQNGIFA-LHGKELSFNLLTVS
                                . .      .: ::    * .*:   .:** .   **   :  :::  . :
```

FIG. 31B

```
ref|YP_001619074.1|     GWSDWVRAVQIMTQNLKQLGIDASLKAYDFSAFFEALQKGT-----FDMSMGWTTVEPTP
ref|YP_001613999.1|     GWSDWVRAVQIITQNLESVGIAASMKTYDFSAFYAALQKG------LFDMSMGWTSVEPTP
ref|YP_001618197.1|     GWSDWVRAVQITTQSLKAVGIEATLKTYDFSAFFEALQKGT-----FDMSMGWTNTEPTP
ref|YP_001614945.1|     GWSDWVRAAQIVTQQVKQIGVEATLKTYDFSAFFEALQKGT-----FDLSMGWSNEEPTP
ref|YP_001471644.1|     GWTDWIAVSQLLSQQLKKIGVELNVTPIDFGAYLAKI-----RQKDFDVAVSWSNYGPNP
RAAC01989               GWSDWDEDALLIKQQLAKVGIAVNVQEEQFSAYYSAIDPGPGQTPHYDLAISWTNVGPTP
                        :          : .*.:  :*:  .:   :*.*:   :          :*:::.*:.  *.* ref|YP_001619074.1|     YNYYRDLMSAELVKPVGEASARNWHRYGDKEADKLFQQFEAATESAEQKRILDEVQMLYA
ref|YP_001613999.1|     YNFYRDLMSADLVKPLGEVAPRNWHRFGAREADVLFHAFESATAPADQKRILDGLQMIFV
ref|YP_001618197.1|     FNYYRDLMAPEFVKAVGEVSNRNWHRFAAKEAEPLFKKFAAATDPAEQKSIVEDLQMIYA
ref|YP_001614945.1|     YNFYRDLLGTATAKPVGETSARNWHRFGAKQADGLFEAFEAATEPAEQKKLIEQLQEIFS
ref|YP_001471644.1|     YIFFQNYLHSS-----NAYTGSNRGGWINKETDELVEKLSQTADMEEIKTIVSKIQEIIL
RAAC01989               YTTYYDMLDSH-----GSFN---LEGYRNAQVDQWFNEFSSTTDSQVQHQVMYRIERLVA
                         :   :  :  .       .       :   :.:  .. :  ::        :  ::   ::  :

ref|YP_001619074.1|     QNAPVIPLFKNPSWGEYSTKRFTGFPTKENPYAKLSPNNPPEYLLVLTEIRP--
ref|YP_001613999.1|     QAAPVIPLFNNPSWGEYSTKRFTGFPTMENPYAKLTPNNPPEYLLVLTELRP--
ref|YP_001618197.1|     TQVPVIPLFKNPSWGEYSTKRFVGWPSKENPYAKLSPNNSPDYLLVLTEIKP--
ref|YP_001614945.1|     ETAPSIPLFPGPSWGEYNTRRFTGFPSKENPYAKLSPNNPPEYLLVLTELKP--
ref|YP_001471644.1|     DNVPAVPLFYNPVWFIYSIKNFTGWPNENNAFVEPRTTGMDKIYLIM-HLQP--
RAAC01989               SQLPVIPLLDGALWYEYNDSHFTGFPTANNLWINPAPYTYQAAAIIMDHLKPVK
                          * :**: ..  *  *.  .*.*:*.  :*  :   .              :::  .::*
```

FIG. 32

```
ref|YP_829900.1|        MRFILRRLGFYLIAFWVSITLNFLLPRFMPGDPVSRMFARTQDRMQPEQIEALRKLLGVD
ref|YP_947699.1|        MRFILRRLGFYLIAFWASITLNFLLPRFMPGDPVSRMFARSQDRMQPEQIEALRKLLGVD
ref|YP_001614944.1|     MRYLLRQLGLYFIAAWASLTLNFLIPRAMPGDPASAMFVRFRGQLQPEAIEALRKAFGFT
ref|YP_001545164.1|     MRFLLRRLGFYAVAAWVSLTVNFYLPRLMPGDPASAIFARFQGRLRPEEIDSLRKAYGLS
ref|YP_001032750.1|     MRFFIRRVAFYIVTAWAAVTLNFFIPRMMPGDPVQALIARYQGQISVDAVNSLRKLFGMD
RAAC01990               MRYFLNRFCFLVLSLWAAITLNFILPRLMPGNPAQAMIAKQAGNINPAALKAIEEQLGLS
                        **::.:.  :   ::  *.::*:** :**  ***:*..  ::.:    ..:     :.::.:   *.

ref|YP_829900.1|        D-RPIWEQYVDYLHNMVTGQMGVSISRFPTPVTEVIASQVGWTLLLGGTALVIAAVVGNL
ref|YP_947699.1|        D-RPIWEQYIDYMHNIFTGQMGVSISRFPTPVTEVISAQIGWTLLLGGTALVVAAVVGNL
ref|YP_001614944.1|     D-EPLYKQYFTYLSHILVGDLGTSVAHFPAKVTEVIATGLGWTLLLSGAAVIVSFGLGTL
ref|YP_001545164.1|     D-APLLEQYFNYLRSLSRGEFGISINFFPAQVTDVISTGFMWTILLAGLATVISFFLGNV
ref|YP_001032750.1|     AHESLWQQYIDYWVKLFHGNLGVSLQSFPTPVSQIISQSLPWTIGLVGLATIIAFVVGTV
RAAC01990               N-GPLWQQYFQYLGNLLTGHWGASFQYFPTPVVNIIETSLPWTIVLLGVVTIISVVVGTL
                         .: :**. *   :  *. * *. **: * ::*   .  **: * *  . ::: :*..:

ref|YP_829900.1|        LGILAAWRRGGAIDSALPPILIFIGSFPYFWLAMGALYLFGVTLGWFPIRHAFSDTIEPS
ref|YP_947699.1|        LGILAAWRRGGAIDSALPPLLVFIGSFPYFWLAMGALYLFGVVLGWFPIRHAFTDGLEPA
ref|YP_001614944.1|     LGIIATWKRGGWLDSVMPPVLMFLGAFPYFWLAMVSLYLLGFVLGAFPLRHAYSDTLSPE
ref|YP_001545164.1|     LGIIGAWRRNGILDSVAPPLLTFIGAFPYFFLAMIALYFLAFQAGWFPLRHAYSDALSVD
ref|YP_001032750.1|     IGIILGWRRGTKWDALIPITTFFS-SVPYFWIGLMAIAIFATVLQWFPQGGSYSVDSLPG
RAAC01990               IGILIAWRRGGTADNVIPVATMFGQAIPTFWLGLILIYFFGFVHHWFPLAHGYGDDVTPG
                        :***  *:*.   *   *   *  :.* *::.:   : ::.        **    .:

ref|YP_829900.1|        F-SWEFMSDVGMHLVLPALTIVLVSVGGWMLGMRNTMIATNAEDYITMAEAKGLRPGRIM
ref|YP_947699.1|        F-TWEFIGDVGAHLVLPALTIVLVSIGGWMLGMRNTMIATNSEDYITMAEAKGLRPGRIM
ref|YP_001614944.1|     W-SLEFIGSVLSHMILPALSIVIATIGGWMLGMRSAMVTVLSEEYITMAQAKGLSQWRVM
ref|YP_001545164.1|     WGSLTFIKSVISHMILPASCIVLASIGGWMLGMRNTMVGILSEDYITMAQAKGLSQQRIM
ref|YP_001032750.1|     L-NWAFMSSVFYYGFLPALTIVLSSMAGWILGMRNMMVTVSSEDYVTVAHAKGLRESVVM
RAAC01990               L-NAPFLASAVYHSILPAVVVFVGSISGWIVGMRNNMITTLGEDYVVFAEAKGVSKRRLI
                          .    *:  ..   :  *** ::.  :: .**::***. *:    .*:*:..*.***:    ::

ref|YP_829900.1|        FRYAARNAMLPSVTSFGMSLGFVVGGALLTEVVFAYPGVGYQLLNAVQGLDYPLMQGLFL
ref|YP_947699.1|        LRYAARNAMLPSVTSFGMGLGFVVGGALLTEVVFAYPGVGYQLLNAVQGLDYPLMQGLFL
ref|YP_001614944.1|     FTYAARNALLPNVTGFGMVFVLAGSLLTEIVFSYPGQGYLLIQAVRNQDYPLMQGIFL
ref|YP_001545164.1|     FSYAARNALLPNVTSFGMALGFVLSGSLLTEIIFAYPGLGYLLLQAVRNLDYPLMQGLFL
ref|YP_001032750.1|     FRYASRNAILPQISGFALSLGFVVSGTLVMEQVFNYQGIGYRLLQATNNHDYPLMQGIFL
RAAC01990               FSYAARNALLPQLTSVAIALSSIIGGQILIEQVFSYPGIGYGLTNAVASEDYPLIQGMFL
                        :  **:***:**..:....:.*.  ::.*    :: :*  *   *  * :*.  . ****:**:**

ref|YP_829900.1|        TITAAVLLANFLVDILYVRLDPRVR-----
ref|YP_947699.1|        TITAAVLLANFLVDILYVRLDPRVR-----
ref|YP_001614944.1|     TITFAVLGANFLVDVIYVFLDPRARGR---
ref|YP_001545164.1|     MITFAVLGANLLVDILYVWLDPRTRR----
ref|YP_001032750.1|     VITLSVLIANVVADIIYAFLDPRTRKEG--
RAAC01990               IIAVTALVINFIVDMLYGRLDPRVRRRGAA
                         *:  :.*  *.:.*::*  ****.*
```

FIG. 33

```
ref|YP_001032749.1|    ------------------------FLRNTKSIIGLSIFTF--FILVAIFGPLLAPFDP
RAAC01991              MTVAAIDVVDPRAKRASRRRNSALRQFFRNPKALAGVVLFGM--FLVVAIFAPAIAPYNP
ref|YP_063070.1|       ------------------------WRDPKCRVGMFLLAA--FLLAAALAPLIAPFDP
ref|YP_001567539.1|    ------------------------NKKAIVGLSIILF--FVIVAVFAPFFAPYNP
ref|YP_001471642.1|    ---------------------------AGIILF--FLTIALLAPYIAPYNP
ref|YP_614737.1|       ------------------------FLRNRKAAIGLTIVLI--YVAIAIAAPLIAPFDP
                                                :.       ::    *   .*  :**::* ref|YP_001032749.1|    NKTSALANAAPSTQHWLGTTNVGQDIFSQIIIGTRGVMVVSLSTGLIATVLAAVIGVSAG
RAAC01991              TSTAFGMLQPPSHAHWFGTTSLGQDVFSQFIWGTRTTLIVGVGAGLLSTVIAILIGVTAG
ref|YP_063070.1|       REAVGGASEGPSAAHWLGTTDNGEDVLSQLIWGAQTSLIVGLIAGLISTAIGLVIGLTAG
ref|YP_001567539.1|    NDFVGPPYSQPTFNHPLGLDRMGRDILSQLIYGTRLSLIVGLSTGALMTSISILIGMTAG
ref|YP_001471642.1|    NDIVDLPYEKPSKLHFLGTDRLGRDIFSQLIHGTRLSLLIGILTGFLMTGISTFFGMTSG
ref|YP_614737.1|       IARVGRPHQPPSVEHWLGTTRMGRDVFSQLVWGTRTSLMVGIVAGLIVTAIGTFIGITAA
                       *:  *   :*      *.*::**:: *::    :::..: :*  : *  :.  ..:*:::.

ref|YP_001032749.1|    FLSGWGDEILSMLTNIFLVIPGLPLIIIMGTMTNAGLAAIVLVISFTGWAWGARVLRSQ
RAAC01991              YVGGVVDSILNALCNIFLVMPGLALLIIIESYVHNTTPYMNGLIIALTGWAWGARVMRSM
ref|YP_063070.1|       YSQGVVDEILSFLTNLALVVPVLPLIVTLASYSPVRGIWMIIFVISVTGWAYGARIKRSQ
ref|YP_001567539.1|    YFGGLVDRILSTIIDVFMVIPGLPLMIVIASYIRIRGVVPIILVIAFTSWAPGARVIRSQ
ref|YP_001471642.1|    YYGGIVDRILSTITDVFLVIPGIPLMIVISSYIRVRSFWTVIIVIALTGWGGGARVIRSQ
ref|YP_614737.1|       YFGGLVDDILNFFTNVVLVLPQLPLLLVLAAFLGQVGPWAIALIIGLTSWAWGARVTRAQ
                       :   *   * **.  :  :: :*:*  ..*::  :  .          ::*..*.*. ***: *:

ref|YP_001032749.1|    TMSLRTRDFVEAARASGESRLRIIIFEILPNLTAILASTFIGTVTAAIMSLVTLSYIGII
RAAC01991              AMTIASRDYIAAARLSGMSTFRIILFEIVPNMTSVIASNVMYACLAAVLAESGLAYLGFE
ref|YP_063070.1|       VISLRTRDYVAAEKLAGDRTPRIILREIMPNMTSLIVVSFMGAALGAIGGEGGLAFLGLG
ref|YP_001567539.1|    TLTMRGREFILASKITGEKSGRIIFSEIMPNMFSLLSSNFFMACLTAIVGEASLEFLGFG
ref|YP_001471642.1|    MLSMKNREFVTAAKIIGEKNIRIVFFEIFPNMLSLIASNFFGSVLYAIIGEASLSFLGLG
ref|YP_614737.1|       AMSLKTRDFIQASAMIGEPTWRMILVEMLPNLLSIIGFNFIGSVIFTIITEATLEFLGLG
                       :::  *::: *    *     *:::  *::.**:  :::   ...:  ::      *  ::*:

ref|YP_001032749.1|    PPSDWSWGTVLYYAQNNGAFTSGQWWWYAPAGLCVAFLGMSLALINFGIDEFVNP-----
RAAC01991              NVASTSWGTMLYWATQNSALMSGAWWWFVPPGLGIALLGTSFALMNFGIDQVTNPRLRTS
ref|YP_063070.1|       DPQTVSWGAMLYQANIGGALLTGQLAWLIAPGLTLALLITSFTLINFGIDTLSNP-----
ref|YP_001567539.1|    DVSSITWGTMLYWAQNSSALLNNSWGWVLAPGAAIATLGASFALLNFSIDEITNP-----
ref|YP_001471642.1|    DVSRISWGTMLYWAQSANALLNGMWAWVLAPGLSIVLLGTAFALLNFSLDEMTNP-----
ref|YP_614737.1|       SPLALSWGTMLYNAQTASAIMVGAWWEVLAPCAAIVLIGVGLSLMNFGVDEIANPRMRTL
                       ::::**  *  .*:    .. :  .::*:**.:*  ** ref|YP_001032749.1|    ------------------------------
RAAC01991              RRRRQVEKLLRELRAQNGEVKADGRDARTGASD
ref|YP_063070.1|       ------------------------------
ref|YP_001567539.1|    ------------------------------
ref|YP_001471642.1|    ------------------------------
ref|YP_614737.1|       GNVAKALRIEKRLLRQRMQEAE----------
```

FIG. 34

```
ref|YP_001614942.1|        ------PLLSVQDLRVEFITPTGPVCAVDNVSFDIAPGEVLGLAGESGSGKSTVAMAIMR
ref|YP_001545162.1|        -----EPLLDVQNLSVEYQTLRGPVQAVSNVSFSIGQGEVFGLAGESGSGKSTIAHAIMR
ref|NP_798861.1|           ------PLISIRNLCVDYITDAGDVRACNNVSFDIAPGEVFGLAGESGCGKSTVAFSLMR
ref|ZP_01262242.1|         ------PLISIRNLCVDYITDAGDVRACNNVSFDIAPGEVFGLAGESGCGKSTVAFSLMR
ref|ZP_01473687.1|         ------PLISIRNLCVDYITDAGDVRACNNVSFDIAPGEVFGLAGESGCGKSTVAFSLMR
RAAC01992                  MAETREPVLQIEDLSVAYVTNTGLVHAVSDVNLTVHRGEIVGLVGESGSGKSTMAYTIMR
                                    *::.:.:*  *  :  *    * *   ..:*.:  :    **:.**.****.****:*  :.**

ref|YP_001614942.1|        LLRPPAVITGGHVYFAGQDVLAMNEEQLRAFRWRKMALVFQSAMTALNPVLTIGEQISDP
ref|YP_001545162.1|        ILHSPAVITGGNVLFDGDDVLEMDMEGLEAFRWRDISMVFQSAMNALNPVLTVGEQIIDV
ref|NP_798861.1|           LHKPPAFITGGEVIFNGEDILQYSDQRMQSFRWSEMSMVFQSAMNALNPVLTMEEQFCDV
ref|ZP_01262242.1|         LHKPPAFITGGEVIFNGEDILQYSDDRMQAFRWSEMSMVFQSAMNALNPVLTMEEQFCDV
ref|ZP_01473687.1|         LHKPPAFITGGEVIFNGEDIIKYSDERMQSFRWSEMSMVFQSAMNALNPVLTMEEQFCDV
RAAC01992                  LLRGDAVVTKGRVRVLGQDVYALSEKELRAFRWSKMSMVFQSAMSALNPVMTVETQIVDT
                           :  :  *.:*  *.*  .  *:*:   . . :.:*  .:::**.***:*:   *: * ref|YP_001614942.1|        IIAH-DGVTPAQAMERAAALLKLVNIDSSRLNSYPHQLSGGMRQRVVIAIAMALKPPFLI
ref|YP_001545162.1|        IQRHQPKTTKQQAKDRAAELLDIVGIDGKRVDDYPHQLSGGMRQRVVIAVALALKPQLMI
ref|NP_798861.1|           IMRHT-GLTRAQARVRAEGLLEIVDIHPSRLSDYPHQFSGGMRQRLVIAIALALNPKMII
ref|ZP_01262242.1|         IMRHT-NMTRAQAKTRAEGLLEIVDIHPSRLSDYPHQFSGGMRQRLVIAIALALNPKMII
ref|ZP_01473687.1|         IMRHT-NMTREQAKKRAEGLLEIVDIHPSRLNDYPHQFSGGMRQRLVIAIALALNPKMII
RAAC01992                  ILAHRPDLSRQAARERAKELLDLVRIDRKHLQSYPHELSGGMRQRVVIAIAIALNPALVI
                           *  *    :   *     .:*  *,  .::..*::***:*:*:**:*   ::* ref|YP_001614942.1|        MDEPTTALDVVVQREILQQIAELKERLGFSILFITHDLSLIAEFSTRIAILYAGKLAETA
ref|YP_001545162.1|        MDEPTTALDVVVQKDIMQQIEYLKKELDFSILFITHDLSLMVEFSDRIGVMYAGEIVEMT
ref|NP_798861.1|           MDEPTTALDVVVQREILQKIYALKEEFGFSILFITHDLSLMVEFSDRIGIMYSGELIEVA
ref|ZP_01262242.1|         MDEPTTALDVVVQREILQKIYALKEEFGFSILFITHDLSLMVEFSDRIGIMYSGELIEVA
ref|ZP_01473687.1|         MDEPTTALDVVVQREILQKIYALKEEFGFSILFITHDLSLMVEFSDRIGIMYSGELIEVA
RAAC01992                  MDEPTTALDVVVQRSILDEIRRIQEQVGFAILFVSHDFSLVAELASRVAIMYAGRIVELT
                           **********:.*:::*   :::...*:***::**:**..*:: *:..:*:*.: * :

ref|YP_001614942.1|        RAKDL-FSDPKHPYTQGLLGSFPSVRGPRRKLQGIPGSPPDMRNPPAGCRFHPRCPQAFA
ref|YP_001545162.1|        AAHEL-FNKPMHPYTQGLMASFPALVGPKETLTGIPGSPPNMLEPPSGCRFHPRCPKAIA
ref|NP_798861.1|           PSKQI-LESPYHPYTKGLSSSFPPLTGPKTKLTGIPGNPLNLLEIPQGCRFQARCDRVHE
ref|ZP_01262242.1|         PSKQI-LESPYHPYTKGLSSSFPPLTGPKTKLTGIPGNPLNLLEVPRGCRFQARCDRVHE
ref|ZP_01473687.1|         PSKQI-LESPYHPYTKGLSSSFPPLTGPKTKLTGIPGNPLNLLEIPQGCRFQARCDRVHE
RAAC01992                  PSHLLNLSERHHPYTEGLLKAIPQLTADEVTIQGIGGYPPDLQDLPPGCAFHPRCPYAMD
                           ::  :  :..   ****:**   ::*  :  . ...:   ** * ::  * **  *:.**   .

ref|YP_001614942.1|        TCQNE-LPVLREIAPEHRG-ACHLY---------
ref|YP_001545162.1|        QCSLQ-QPTLREVEPGHFV-ACHLY---------
ref|NP_798861.1|           ACTRV-PTQLRQIEPGRYS-NCHLYGDTIAQAKV
ref|ZP_01262242.1|         ACTRV-PTQLRQIEPGRLS-NCHLYGDTIAQAKV
ref|ZP_01473687.1|         ACTRV-PTQLRQIEPGRFS-NCHLYGDTIAQAKV
RAAC01992                  VCRRV---RPAQVRAGEKVLECHLFNEAEVKAHV
                            *              ::  . .     ***:
```

FIG. 35

```
ref|YP_001337166.1|   ------------------------------------------------------RIAFIPK
ref|YP_001591175.1|   ------------------------------------------------------RIAFIPK
ref|ZP_00133639.2|    ------------------------------------------------------KVAFIPK
ref|YP_355005.1|      ------------------------------------------------------EIAFIPK
ref|YP_644454.1|      ----------------------------------------------------PNKICMMPK
RAAC02175             MKLRTKKAKHKALGGLAAAALVATVTGCGTVATTASTPNSNAGSAAASSSKPIKVAFIPK
                                                                            .:.::**

ref|YP_001337166.1|   LVGVGFFTSGGNGAKEAGKALGVDVTYDGPTEPSVSGQVQLINNFVNQGYNAIIVSAVSP
ref|YP_001591175.1|   LVGVGFFTSGGNGAQEAGKALGIDVTYDGPTEPSVSGQVQLVNNFVNQGYDAIIVSAVSP
ref|ZP_00133639.2|    LVGVGFFTSGGQGAVEMGKKLGLDVTYDGPAEPSVSNQVQMINNFVNQGYNAIIVSAVSP
ref|YP_355005.1|      LVGVGFFTSGGNGAMKMGEELGVKVTYDGPTEPSVSGQVQFVNNFVNQGYGAIVLSSVSP
ref|YP_644454.1|      LVGIPYFNAAEKGAREAARELGVDLVYDGPTEALAADQVEFIEQFIQQQCDAITVAANDP
RAAC02175             EIGIPYFTGADQGAQSVAPKLHIQLTYNGPTQASAADQVSMINSYVAQGYNVIAVSANDP
                      :*: :*... :**  . .  * :.:.*::.. .:..:::.::  *  ..* ::: .* ref|YP_001337166.1|   DGLCPALKRAMQRGVKVLTWDSDTKPECRSIYINQGTPQQLGGLLVEM-AEKQVSKPAAK
ref|YP_001591175.1|   DGLCPALKRAMQRGVKILTWDSDTKPECRSYYINQGTPKQLGSMLVEMAA-HQVDKEKAK
ref|ZP_00133639.2|    DGLCSTLKRAMKKGVKVLTWDSDTQPECRSYYINQGTPTQLGSMLVEMVSSQI-SKPKAK
ref|YP_355005.1|      DGLCPALKQAMARDVLVMTWDSDVNPDCRSYYINQGTPEQLGGLLVDMANDGLEGKEKAK
ref|YP_644454.1|      DALAPAMKKAKQAGIATGAWDADVAEDARDVFVNQATFQAIGYKLVDVMAEQTGGKGKFL
RAAC02175             TSLAPALESAMRRGVKVITWDSDVIPSARQFFVDQATAQGIGTTLVQITAEHFKSQKNVE
                       .*..:::  *     .:    :**:*.   ..*. :::*.*  :*  **::       .:

ref|YP_001337166.1|   VAFFYSSPTVTDQNQWVKEAKAKIEKEHPQWQIVTTQFGYNDATKSLQTAEGILKAYPDL
ref|YP_001591175.1|   VAFFYSSPTVTDQNQWVKEAKAKISQEHPGWEIVTTQFGYNDATKSLQTAEGIIKAYPDL
ref|ZP_00133639.2|    VAFFYSSPTVTDQNQWVKEAKAKIEKEHPKWEIVTTQFGYNDAIKSLQTAEGILKAYPDL
ref|YP_355005.1|      VAFFYSSPTVTDQNAWAEAAKARIAADHPGWEIVTTQYGYNDAQKSLQTAESILSAYPDL
ref|YP_644454.1|      V--VTGSLTAPNQNAWLKEMRERMRQKYPQMEIASVQPGEEDLQKGIDITKDYLRANPDT
RAAC02175             VGILSSTPTNPNQNAWIAVMKQAIQSKYKNLHIVTIQYDQEQPDVGLTAAENMLRAYPQM
                      *  . ..: *  .:** *   :   .:   .*.: * . :: .:  ::. : * *:

ref|YP_001337166.1|   DAIIAPDANALPAAAQAAENLKRQG-VAIVGFSTPNVMRPYVERGTVKAFGLWDVVKQGK
ref|YP_001591175.1|   DAIIAPDANALPAAAQAAENL-KRNNLAIVGFSTPNVMRPYVQRGTVKEFGLWDVVQQGK
ref|ZP_00133639.2|    DAIIAPDANALPAAAQAVENLKRQGTI-VVGFSTPNVMRPYVKRGTVNQFGLWDVVKQGQ
ref|YP_355005.1|      DAIIAPDANALPASAQAAENLGRAGEVTIVGFSTPNVMRPYVKRGTVERFGLWDVTQQGA
ref|YP_644454.1|      AGVFGITSVALPGAAEAVQQMGLKGEVAVTGLSTPNEMKPYVKSGVVEKFVLWNPVDLGY
RAAC02175             KAIISPDSVGVPAAAEAVEKLGLKGKVFVTGLADPIQMKQYVNDGTVQEFVLWDVPKLGA
                      .::: .   : ..*..:*:.*::       . : :.*:: *  *: ** *.*: * **: . * ref|YP_001337166.1|   IAVNVADRLLK-KGDLNVGDSVEVKDIGSLKVEPNSVQGYQYEAKGNGIVLLPERVVFSK
ref|YP_001591175.1|   ISVYVANALLK-NMPMNVGDSLDIPGIGKVTVSPNSEQGYHYEAKGNGIVLLPERVIFNK
ref|ZP_00133639.2|    LSVAVANELLK-GNSLKVGDKLNVDGIGEVEVSANKVQGYEFEAKGNGIVLLPERVVFTK
ref|YP_355005.1|      ISVAVAAHVLK-DGPLNVGDSLEVPGIGSVEVSPNSVQGYDYEAEGNGIILLPERTVFTA
ref|YP_644454.1|      LAVYVANAQVE--GTLPESGTFKAGRLGEVKMLAP------------DEVLLGPPLVFTR
RAAC02175             LTMYVARAVVD--GTMPVNGTFKCA-LGSFKVQN------------RVVLLGNPTIFNK
                      ::: **   :.   :  .....  :*..  :            :**   :*.

ref|YP_001337166.1|   ENINNYDF
ref|YP_001591175.1|   NNIDKYDF
ref|ZP_00133639.2|    DNIDNYDF
ref|YP_355005.1|      ENIDNFDF
ref|YP_644454.1|      ENIDEYDF
RAAC02175             SNINNANY
                      .**:: ::
```

FIG. 36

```
gb|EDR95515.1|      ------------------------------DFLNISNLLFSTNDFLFIAIAAIPMTFVIV
ref|YP_029022.1|    ------------------------------DFLNISNLLFSTNDFLFIAIAAIPMTFVIV
ref|YP_037038.1|    ------------------------------DFLNISNLLFSTNDFLFIAIAAIPMTFVIV
ref|ZP_02260050.1|  ------------------------------DFLNISNLLFSTNDFLFIAIAAIPMTFVIV
ref|ZP_01440479.1|  ------------------------------SDRFLTTANLLNQARLMTEVGLIAIPMTFVIV
RAAC02176           MRGVAENRIWSLAIAGLLILEIGFFGVLSPDFVSPQNLLASTENFLPVGFMALSMTLVII
                                                  *:.  ***  .:.  :    :.: *:.**:**:

gb|EDR95515.1|      TGGIDVSVGSIMGLTSILIGVLWMNG-ISILFAVIISLIISCLAGALNGFIIKMTDVEPL
ref|YP_029022.1|    TGGIDVSVGSIMGLTSILIGVLWMNG-ISILFAVIISLIISCLAGALNGFIIKMTDVEPL
ref|YP_037038.1|    TGGIDVSVGSIMGLTSILIGVLWMNG-ISILFAVIISLIISCLAGALNGLIIKMTDVEPL
ref|ZP_02260050.1|  TGGIDVSVGSIMGLTSILIGVLWMNG-ISILFAVIISLIISCLAGALNGFIIKMTDVEPL
ref|ZP_01440479.1|  TGGIDLSVGSIMGLCAILVGVFWQNAGLPLPAAVGLSLVAGTAAGLANGIIITRFRVPPL
RAAC02176           TGGIDLSVGSMMSLCGVVMGLLWQHG-VNIWLAALLSILLGALLGFINGQLIVRTGIQPL
                    *****:****:*.*  .:::*::*  :.   :  *. :*::   .    *   ** :*      : **

gb|EDR95515.1|      VVTLGTMFLYGGIALVISGGAGGSGYEGISGLPDAFVQLASGSFIG-IPNLLWLLIVLTV
ref|YP_029022.1|    VVTLGTMFLYGGIALVISGGAGASGYEGISGLPDAFVQLASGSFIG-IPNLLWLLIVLTV
ref|YP_037038.1|    VVTLGTMFLYGGIALVISGGAGASGYEGISGLPDAFVQLASGSFIG-IPNLLWLLIVLTV
ref|ZP_02260050.1|  VVTLGTMFLYGGIALVISGGAGASGYEGISGLPDAFVQLASGSFIG-IPNLLWLLIVLTV
ref|ZP_01440479.1|  IATLATLALYRGLAEGI--SQARS----VRGYPEWFAQLGQGQILG-IPTQLWLFALVAI
RAAC02176           IATLATLFIYGSLAMVLVGQGEGS----IYGFPQSYLSLGTGTVLKWIPIQLIFYGVVAC
                    :.**.*: :*  .:*    :           *  :  *  *: :    .*. *   .:    **    * :    :::

gb|EDR95515.1|      LCAVLFHRTIYGRHVKLTGANENAAKYTGIMTKKVVIIAYMLSGLGGGLGGTFLTAYFGS
ref|YP_029022.1|    LCAVLFHRTIYGRHVKLTGANENAAKYTGIMTKKVVIIAYMLSGLGGGLGGTFLTAYFGS
ref|YP_037038.1|    LCAVLFHRTIYGRHVKLTGANENAAKYTGIKTKKVVIIAYMLSGLGGGLGGTFLTAYFGS
ref|ZP_02260050.1|  LCAVLFHRTIYGRHVKLTGANENAAKYTGIKTKKVVIIAYMLSGLGGGLGGTFLTAYFGS
ref|ZP_01440479.1|  AGIFILRFTTFGRTTYAIGNNEAAAEFSGLPVERTKLLIYTASGFISALAAIVFVSRVST
RAAC02176           LFGFLLKYTSYGRQVYFVGNNEGAALYSGLQVNRVKTITYVLSGCMSGVAAVFMGAYFAS
                    .:::   *  :**  .     *  ** **   ::*:  .::.    :  *    **   ..  :..  .:   :  ..:

gb|EDR95515.1|      ARADMGSETILPIITAVVLGGTLITGGKGSIIGTVLASIFIGLMQYGLQMTGLTNEQSNV
ref|YP_029022.1|    ARADMGSETILPIITAVVLGGTLITGGKGSIIGTVLASIFIGLMQYGLQMTGLTNEQSNV
ref|YP_037038.1|    ARADMGSETILPIITAVVLGGTLITGGKGSIIGTVLASIFIGLMQYGLQMTGLTNEQSNV
ref|ZP_02260050.1|  ARADMGSETILPIITAVVLGGTLITGGKGSIIGTVLASIFIGLMQYGLQMTGLTNEQSNV
ref|ZP_01440479.1|  TRSDMGNGIELEVITAVVLGGTSIFGGRGMVIGTLIGLCLMQILQNGLSLAGVRGDGTTV
RAAC02176           VRGDMGTNYELSVITSCLVGGVNVFGGSGTILGAFLGTFLLGVLQQGLNMLNVSSVEQSV
                    .*.***.    *  ::   ::. :  **  *  :  ::*:..:.    ::  ::* **.:    .:   .     .* gb|EDR95515.1|      VIGIILILSV---------------------------
ref|YP_029022.1|    VIGIILILSV---------------------------
ref|YP_037038.1|    VIGIILILSV---------------------------
ref|ZP_02260050.1|  VIGIILILSV---------------------------
ref|ZP_01440479.1|  VIGAILIVAVLISNILGRF------------------
RAAC02176           VTGAMLIAAVGLQQLSGLFSRRRRVSRQDSSSAVETTTSARD
                    * *  :**  :*
```

FIG. 37

```
ref|YP_001565594.1|     ------------------------------PHFMTWGNWADILRQTSINGILAIGMTCVVLTA
RAAC02177               MSGLLKRREFSLVVFILIFLLVMLFVTPRFLQLGNLINILLNISTVGILAMGQCLVIITK
ref|NP_832709.1|        MKHMLKMHETSIILLLLIYIAIVGMINPSFIQFNSLSLLMKSSVILVVLAIGQSFVLFTK
ref|ZP_00239479.1|      MKRMLKMHETSIILLLLIYIAIVGMINPSFIQFNSLLIKSSVILVVLAIGQSFVLFTK
ref|YP_001178244.1|     MKTLLKNRELSAFLAILALFGVLVALNPAYLSFQTLGMIFASSQILILLALGAALVMLTR
ref|YP_001337168.1|     MKTLLKNRELSAFFAIVALFVVLVALNPAYFILQTLAMIFASSQILCLLALGATLVMLTR
                                                      *  ::   .    ::  .     :**:*    *::* ref|YP_001565594.1|     GIDLSVGAILALAGMVGAWLAADGQGLAVSVGAGLGVGMLLGGVNGLLVAWFAVPPFVAT
RAAC02177               GIDLSVGANMGLVTLVVGTLLLNGVPTWLSIAIGVATGLVCGGLNAVLISLLRLPPIIVT
ref|NP_832709.1|        NIDVSVGSSMGLSAAVCGMMLTNGYSAFLSIFVAIILGAIIGFVNGIGVAKFRVPAIIMT
ref|ZP_00239479.1|      NIDVSVGSSMGLSAAVCGMMLTNGYSAFLSIFAAIILGAIIGFVNGIGVAKFRVPAIIMT
ref|YP_001178244.1|     NIDVSVGSTVGLCAIAVGVALNNGYSLPVSMLFALAIGALAGAFNGLLVVGLRIPAIVAT
ref|YP_001337168.1|     NIDVSVGSTVGLCAIAVGVALNYGYGLATAIAFALAIGALAGAFNGLLVVGLRIPAIVAT
                        .:*:  :.*       . .      *      ::     .:  *  :  *  .*.:  :   :  :*.::  * ref|YP_001565594.1|     LGMLSAARGLTYIYNDGMPVSELPDGFLAIGAGQLGPVPMPIVIFAVAVAVFAFVLRYTV
RAAC02177               LGTLSLFSGLMYMVTNGQWIQNLPSSFLAIGNSKVVGIPGPVIVLVIVLVSVFMEQTV
ref|NP_832709.1|        LGMLGIIRGTMLIFTGGKWIEDIPNDFKQLSSIIILGLPITVWFVLIILLLLYFFLRKVP
ref|ZP_00239479.1|      LGMLGIIRGAMLIFTGGKWIEDIPSHFKQLSSIVILGLPITVWFVLIILLLLYFFLRKVP
ref|YP_001178244.1|     LGTLGLYRGAMLLWTGGKWIEGLPSSLKSLSEPVALGVSPLGMAVLFLVLIGAWTLSRTV
ref|YP_001337168.1|     LGTLGLYRGVMLLWTGGKWIEGLPDSLKSLSEPAFIGVSPLGWLVLALLLAGGWLLSRTA
                        ** *.   *    :  ..*   :. :*.   :   :.            :.   .  :       :  .

ref|YP_001565594.1|     YGRYIYAVGGNLRSAKTSGINTRAIVLLVYVVSGLLAGLAGILLASRTTAALPQAGVSYE
RAAC02177               LGRYIYAVGNNPNAARLAGLSTNRTIIVPYVLMGLLAGIAGVLYLSYNGFSTPTTGADLN
ref|NP_832709.1|        LGRYFYAVGDNEDGARLIGIPVNKVKIYAFMISGISAALAGCIFVMNIGFVPNQTGTGLE
ref|ZP_00239479.1|      FGRYFYAVGDNEDGARLIGIPVNQVKIYAFIISGISAALAGCIFVMNIGFVPNQTGTGLE
ref|YP_001178244.1|     SGRDFYAVGDNLAAARQLGVAVNRTRMLAFTINGMLAACAGIVFASQIGFVPNQTGSGLE
ref|YP_001337168.1|     FGRDFYAVGDNLAAARQLGVAVNRTRMLAFTLNGMLAACAGIVFAAQIGFVPNQTGSGLE
                         ** :****.*   .*:  *:  ..       :  :  :  *: *. **  :         :*  . :

ref|YP_001565594.1|     LDAIAAVVIGGTSLSGGTGSLGGTVVGALLIGVINNGLNLLGVSSYYQQLIKGVIIVGAV
RAAC02177               LESIAAAVIGGTNVFGGRGTALGSVLGAVLLGVITEALVFFHLPAVWNDAVEGLIILIAV
ref|NP_832709.1|        LQVIAAAVLGGIHLKGGTGSLFGAALGALFLETISSSLVFLKIPAFWNNAISGFLLLLII
ref|ZP_00239479.1|      LQVIAAAVLGGIHLKGGTGSIFGAALGALFLETISSSLVFLKIPAFWNNAISGFLLLLII
ref|YP_001178244.1|     MKAIAACVLGGISLLGGTGTLIGAFLGAFFLTQIDTVLVLFRLPAWWNDFIAGLVLLGVL
ref|YP_001337168.1|     MKAIAACVLGGISLLGGTGTLLGAFLGAFFLTQIDTVLVLFRLPAWWNDFIAGLVLLGVL
                        :.  *** *:**   :  **  *:  :** *:  :**.::  *    *  ::  :.:  :::  :  *.:::  :

ref|YP_001565594.1|     LLDSSRRRA-----
RAAC02177               IADSGLRRSQRVAG
ref|NP_832709.1|        ILDSVMKK------
ref|ZP_00239479.1|      ILDSVMKK------
ref|YP_001178244.1|     VLDGRLRQA-----
ref|YP_001337168.1|     VLDGRLRQA-----
                        : *.   ::
```

FIG. 38A

```
ref|YP_001546405.1|    --------------SLLVLTLILAACGSDS----------TATTTSNTGSTNPAEVKGEI
ref|ZP_02171436.1|     --------------GENDSANNGSASANND----------DANENNNAGDGD-EDISGEV
ref|ZP_02295559.1|     -----MRFKLLAATAAVA-VLASGSAYA----------------QSAN---------L
ref|YP_765572.1|       --------------------------------------------QSAN---------L
ref|NP_106947.1|       ---------------------GSAPAFA----------------QSGE---------I
RAAC02613              MRAKKIRYATMAASVAMAGIMASGCGTSTAS---------RTGTAPTQQESASTHQPVTI
                                                                                :

ref|YP_001546405.1|    TVWAWNVAAKSLEATVPSFNQKYPNVKVTVQDIGRTDVYDKLTSGLQAGGAGLPDVVAIE
ref|ZP_02171436.1|     TAWGWNVAAAAMEQAIEGFNELYPNVTVNIEDIGREDVYDRLTVGLAAGGSGLPDISMVE
ref|ZP_02295559.1|     TIWSWNVAASALKSTLPGFNKQFPDIKITVEDLGNSQVFDKTLAACAAGGDGLPDIVSIE
ref|YP_765572.1|       TIWSWNVAASALKSTLPGFNKQFPDIKITVEDLGNSQVFDKTLAACAAGGDGLPDIVTIE
ref|NP_106947.1|       TIWSWNVAASSLKATVAGFNKLHPDIKVTVQDLGNQPTYDKSIAGCAAGGVGLPDIVTIE
RAAC02613              TVASWNDAADSLRAEIPGFEKKYPWIKVNVEYVDG--TYQKVIPELVAG--DAPDIIQVQ
                         *  **  **  ::.    :  .*::  .*  :.:.::  :.     .:::    **  . **:   ::

ref|YP_001546405.1|    SDRMDVYTSTFPDGLADLTSR--ASKYEKDFDPSKWAQSKISD-KIRSIPWDSGPTGLWY
ref|ZP_02171436.1|     TDRLDNYFAEFPQGFVNLDEYG-FNEHEDKFADSKVEAVKGPDGNNLAAPWDIGPAGVFY
ref|ZP_02295559.1|     NFEAEIFWSRFPDCFANLKELGYTADIQAKF-PDFKRTELEVGDVAYAMPWDSGPVAVFY
ref|YP_765572.1|       NFEAEIFWSRFPDCFANLKELGYTADIQAKF-PEFKRTELEVGDVAYAMPWDSGPVAVFY
ref|NP_106947.1|       NGEAENYWSQFPDCFVDLHTLGYTSEDQKKF-PDFKRTELEVGDKAYAMPWDSGPVAAFY
RAAC02613              QRDFQTFLHKFPGDFVDLTPYMSSIKN---HIAPVALDVTVQNGHIYAAPWDLGPAALYY
                           :    **  :.:*      .   .            : * .. :* ref|YP_001546405.1|    RVDIFEQAGVDPKSIETWADLIAAGEKILAATDGK----TKLLPVD-----IVADDA---
ref|ZP_02171436.1|     YVPHFEEAGVDPDDIETWDDFIAAGEDIL-DATG-----AAMVPVD-----IANDDA---
ref|ZP_02295559.1|     RRDLYEKAGVDPSTISTWDDFIAAGKKISAANPG-----VVMAQAD-----FNGDSE---
ref|YP_765572.1|       RRDFYEKAGVDPSTINTWDDFIAAGKKISAANPG-----TVMAQAD-----FNGDSE---
ref|NP_106947.1|       RRDFYEKAGVDPASIKTWDDFIAAGKKIQAANPG-----VSMTNAD-----FNGDTE---
RAAC02613              RKDLFREAGINPTSIKTWSDYLAAGKKLVAHFHG----KVKMLAEN-----TSEPSQ---
                         :.:**::*   *.** * :***:.:         *       . :         :

ref|YP_001546405.1|    --GFR----MMTSQLGVCCYFNNDGKINLTNDKSVQALTLLKEINDKGLVANINGWDGTV
ref|ZP_02171436.1|     --IFR----MMMNQLGVY-YFDADGAIEIASDDAALAMSKIQEMHEKDLVANVDGWDGTV
ref|ZP_02295559.1|     --WFR----MIANEQGCGYYSTDGQNITINQPACVATLQKVKEMKDAGTLT-AANWEEKI
ref|YP_765572.1|       --WFR----MIANEQGCGYYSADGQNITINQPACVSSLQKVKEMKDAGTLT-AANWDEKI
ref|NP_106947.1|       --FFR----MISNEQGCAYFAEDGGSITVSEPKCVDALTKVKEMKDAGIVSSAD-WGTKI
RAAC02613              --GIQTTLMILVNELGGS-YVNQNGDIDFLNPQLEKAMSVIQQWGKAGIVADAPTWNDGI
                        ::      ::  .: *  :   .   *  ..      ::   :::       *   :

ref|YP_001546405.1|    AATKNGDVATVPFGVWYSGTIIDQAPDLSGKWDVMLLPAFEKGGNRAANLGGSTLAIPAA
ref|ZP_02171436.1|     TSTVNHTVATIPFGVWYAGTITDQAPDQSGDWGVFKLPAFEEGGNRDANLGGSDLTILSS
ref|ZP_02295559.1|     QADTAGKAASQLYGGWYEGTVRSTSPDLKGKWGVYRMPSLTADGPHAANLGGSSLAISAT
ref|YP_765572.1|       QANTAGKAASQLYGGWYEGTVRSTSPDLKGKWGVYKMPSLTADGPHAANLGGSSLAISAT
ref|NP_106947.1|       TNNTAGTVATQVYGGWYEGTIRTESAGENGKWGVYLMPSLTADGPRAANLGGSSLAITSA
RAAC02613              AAFANGQVATILSAVWYAGTMMNSAPKQSGLWGIVPLPAFTPGGNNEADTGGSVLAITKD
                          .*:    .  :   :.   .* *.:  :*::    .* . *:  *** *:* ref|YP_001546405.1|    TKNLDAAWLFVEHALATSEGQNIMMEKFGIWPSYQPAYSA--DLYSKPVAF-FNN--QPI
ref|ZP_02171436.1|     TEYPEAAYAFVEYFTTEIEPQIEGMTEYGLFPSLLATYDE--PYFQENNEF-FND--EPI
ref|ZP_02295559.1|     SANKEAAWKFVNYALGTDEGQITMLKEFGLVPSLLS--AEKDPFVNEPQPY-WGG--QKV
ref|YP_765572.1|       SANKEAAWKFVNYALGTNEGQVTMLKEFGLVPSLLS--AVQDPFVNEPQPY-WGG--QKV
ref|NP_106947.1|       SKNKEAAYEYLKYTLGTNEGQITMLKEFGLVPSLVS--ALNDPVSQGLPY-WGG--QAV
RAAC02613              SKNVQAAWDFINYCLYTVPGE-NVQLKYGLFPSWESYYTAKGTDFDQNFPY--FG--MPI
                        :    :**: ::::        :     ::*: **  .           .:  :    .    :
```

FIG. 38B

```
ref|YP_001546405.1|    WKLFADEIKNIPPAT--YTKDYAKGQAVLASAQAKVLSQGM-DPKQALQEAAAELANQTG
ref|ZP_02171436.1|     WSLFADVVEGTLPAN--YTNDYARAFRYASDAQANALLSGE-DVQVALQEAAAERIANETG
ref|ZP_02295559.1|     WADILATLPKIVPSR--GTAFQSDAEAIFKATQTKFFAGGYPDAKAALDDAANQIASATG
ref|YP_765572.1|       WADILATLPKIVPSR--GTAFQSDAEAIFKATQTKFFSGGYPDAKAALDDAANQIASATG
ref|NP_106947.1|       WKDILGTLPKVVPSR--GTQFQSDAEIIVRAVQTKYLAGGYPDAKAALDDAAKQIAAATG
RAAC02613              YKFFASVSKHIPTTN--YGGYFEDYSQPLSQAYISVFKGAN--IEQALQTAETNAARISG
                       :  :             .:          .  . :  .    : **: *  . *  :* ref|YP_001546405.1|    REIA--
ref|ZP_02171436.1|     RDI---
ref|ZP_02295559.1|     LPIA--
ref|YP_765572.1|       LPIA--
ref|NP_106947.1|       LPVKS-
RAAC02613              QPISNG
                           :
```

FIG. 39

```
gb|AAD33665.1|AF135398_2    --------------------------------PFLFLTPYALLFAVFW
dbj|BAA28360.1|             --------------------------------PYLFLAPYLVFFGLFW
ref|YP_765571.1|            --------------------------------YAFLAPYLLIFATFW
ref|NP_357451.2|            -------------------------------IAYAFLAPYLLIFATFW
RAAC02614                   MSTIQRESVVTERGTRSLTQLLRFLRQPGVPLWIPYVFITPFFIIFAVFM
ref|ZP_02016963.1|          ----SRRAMRPVWDRVRFARQDLTAATPTLPR-VAYLFIAPFFLLFSVFL
                                             :  *::*:  ::*.  * gb|AAD33665.1|AF135398_2    AWPIAYSLYLSFLN-------------------TRVYPWRLEVGV-NWG
dbj|BAA28360.1|             AWPIVYSFYLSFVN-------------------TRVYPWRLEPAL-NWG
ref|YP_765571.1|            VWPIINSFLISFQN-------------------TRINPWKYSFQA-NWG
ref|NP_357451.2|            VWPIISSFMLSFQN-------------------TRINPWRFAPSM-NWG
RAAC02614                   LYPIVDTLVLSFENWS-----------------TVQSTW---VGIQNYR
ref|ZP_02016963.1|          AFPVFYTLYLSFFEYQGVGQGSLFWIDLGPVYIEIPQIAQLNFVGLGNYA
                             :*:  ::  :**  :                          .      *:

gb|AAD33665.1|AF135398_2    RLLQDPFFWTALKNTLFILLVQVPLMLALA-LLALALNSALLRAKGFFRF
dbj|BAA28360.1|             RLLQDPFFAVALKNTLFILAVQVPLMLALALLLALALNSALLRFKGFYRF
ref|YP_765571.1|            RLFYDPAFYNALYNTLIILVIQVPVMIALATVMAVMLNSPLLKARPLFRF
ref|NP_357451.2|            RLVSDPAFYNALYNTLIILVIQVPVMIALATVMAVLLNSPLLKVRPLYRF
RAAC02614                   LVITDPAFWTSLLNDAFILLIQVPFMLFIATLLAVALNARFLKLKWLFRL
ref|ZP_02016963.1|          RLLGNDLFWQSMFNTSYILVIQVPLMIGLALALALALNASFLRLKGVFRT
                             :. :   *   :: *       :*.*:  :*   :*: **  :*:   ..:* gb|AAD33665.1|AF135398_2    AFFAPVVVGAVAYSAVFRLLFNTEFGAVNALLRTLGHPGYDWLYAPGPAM
dbj|BAA28360.1|             AFFAPVVVGAVAYSAVFRLLFNTEFGAVNALLRALGHPGYDWLYAPGPAM
ref|YP_765571.1|            AFFAPVVVGEVAYAAVFRLMFSLDFGIINKLISAVGLSPVSWFDNANAAM
ref|NP_357451.2|            AFFAPVVVGEVAYAAVFRLMFSADFGIINKLITSVGLSPISWFDNANAAM
RAAC02614                   LIFFPVLVDAVTYTIAFQLIFNPSFGMMNYLLHLVGLPSINWIGNSWAAR
ref|ZP_02016963.1|          AIALPVSANLVAYSTVFLLLFNEQLGFLNYVLAGVGIGPVPWLTDGFWAR
                             :  ** ..  *:*:  .*  *:*.  .:*  :*  ::   :*        *:        * gb|AAD33665.1|AF135398_2    AVIIIALTWRWTGYNAIILLAGLQSIPKELYEAAALDGAGPWQRFWHVTL
dbj|BAA28360.1|             AVIIVALTWRWTGYNAIILLAGLQNIPKELYEAAAIDGAGPWQQFRHVTL
ref|YP_765571.1|            ALIILAVTWRWAGYNAIIILAGLQSIPDDVYEAATLDRVSKVQQFFHITL
ref|NP_357451.2|            ALVIIAVTWRWAGYNAIIILAGLQSIPGDVYEAATLDKVSKRQQFFHITL
RAAC02614                   LAIFLVVTWRWTGYNAIIILSGLQNIPEEVYESAVVDGAGRVRTFFQITL
ref|ZP_02016963.1|          NTIIAAVTWRWTGYNMIILLAGLQTIPQQLYEAAAEIDGANRWEKFRYVTL
                             ::  .:****:***  **:*:***.**    ::**:*    :*    . .   *   :**

gb|AAD33665.1|AF135398_2    PGIRPVLLFALILSIIGTLQLFTEPFLITG-GGPGNATMTLGVYLYQQGF
dbj|BAA28360.1|             PGIRPVLLFCLVLSIIGTLQLFTEPFLITG-GGPGNATMTLGLYLYQQGF
ref|YP_765571.1|            PLLKPIILFCVVLSVIGTMQLFTEPFLITNRGGPGGGTETLGLLLYRQGF
ref|NP_357451.2|            PLLKPIILFCVVLSVIGTMQLFAEPFLITNRGGPGGGTETLGLFLYRQGF
RAAC02614                   PLLRPVILFCTILSTVGTLQLFTEPYILTG-GGPGNATETPMLYLYNIGF
ref|ZP_02016963.1|          PQLKPVMLFVVVLSTIGTFKLFAEPYVITG-GGPTNSTITIVQYIYRQAF
                             *  ::*::   :  ::::***:::*.   ***   ..*   *    :*.  .* gb|AAD33665.1|AF135398_2    RSFNFGYASAIAYTVALLAALFSFLQMRLWR------
dbj|BAA28360.1|             RSFNFGYASTIAYTVALLAAAFSFVQLRLWR------
ref|YP_765571.1|            TSLNFGYASAIAYTMAALAVSISLLNLWVGR------
ref|NP_357451.2|            TSLNFGYASAIAYTMAALAIAISLLNLWVGR------
RAAC02614                   QNYNFGLASAGTYILTTIIAILSYFQIRVSRGGDYSA
ref|ZP_02016963.1|          VNFNLGYASALTVVFVAVVSVFSVVQIKI--GGE---
                             .  *:*  **:  :    :    ..  :   :*  .::   :
```

FIG. 40

```
ref|ZP_02171438.1|        -----------YTALMIGVILSTFPFYWMFIGATNPSGAIFSVPPNLLPGDHFMENFRNL
ref|YP_176793.1|          -----------YVVLAAGLFITLGPFYWMVVGATNSSGALLSVPPNVIPGTHLLENARNL
ref|YP_001546403.1|       -----------YLLLVVGAFLSLFPFYYMFVQASQPSSEVLRFPPHLWFGSAAWSNIQGL
ref|ZP_02016964.1|        --------RFLTYAFVITMVVVMMVPLYWMLVAATLPQEQFLQFPPRLIPGTAFLDNFAAL
ref|ZP_01188237.1|        -------KALLYFILIFGVLITFFPFYYMIVLATRSVEEIFNFPPPLWFGNAAQENIQIL
RAAC02615                 MRESIPVRVLSYVFLVIAVVVSIYPIYWIYVASTLSDGQIFHFPPANWFGGHLLQNVRML
                                      *  :      .:    *:*::  : ::    .:  .**    *    .*    * ref|ZP_02171438.1|        NEGVGIIRVMMNSLIIALTFTFFSVMISASAGYAFAKYKFKGRDPIFFMLLLAIMIPYHV
ref|YP_176793.1|          LNNIDIFRALWNSIFITVTFTVIAGLFSAAAGYAFAKYEFKGKNAIFSMFLVSMMIPYQA
ref|YP_001546403.1|       FAN-GFGRSLFNSAFIAVVYASLSVFIASLAGYAFAKFRFRGRSILFGMFLLVLMIPYHV
ref|ZP_02016964.1|        QERLDFVRTIRNSVLIAVVYTLLSLVLCSMAGFAFAKYEFKFKEPIFYTILATLVLPIQL
ref|ZP_01188237.1|        LDKLPFFQNIFNSIIVATLATLLVLFFCSLGGYGFAKYNFRGKEKLFFLMLASMMIPPLL
RAAC02615                 ESTMPVWRDLANSIVVSGITTISVVFFSAMVGFAFAKYRFWAKSFLFFVVLITIMIPMQT
                           .  :   :  ** .::        :        .:.:  *:.***:.*   :. :*   .*    :::* ref|ZP_02171438.1|        TLIPLFQLMADLG------WLNTYRAVILPHLAYPFAIFLMRQNMRSVPDALIEAARVDG
ref|YP_176793.1|          LIIPQFELFARMG------ILNSYSAIILPQLAYPFAIFLMRQSMKSIPDSVLESARIDG
ref|YP_001546403.1|       TAVPLFQLMAKITLFGDPTWISSYQAVILPALANPFGIFLMRQSMQSLPDDLLDAARIDG
ref|ZP_02016964.1|        LVIPLFLLMAQLD------WTNTFRAIILPWAANPIGIFLMRQNMKSIPDALLESARMDG
ref|ZP_01188237.1|        SIIPWFIMMKAFG------WINSFKPLIIPGAANAFGIFLMRQFMEEIPDEIIDAARIDG
RAAC02615                 TLIPLFIIVTKLH------WENTYQGLIVPFLVNGFGVFFMRQQMQSFPSELLEASRIDG
                           :*  *  :.  :           .::  :*:*   .  ..:*:***  *...*.  ::::::*:**

ref|ZP_02171438.1|        AGEFKIFFRVILPTMRPALAAVAIFLFMFQWNNFLWPLVALGDSSMHTLPVALSGL---V
ref|YP_176793.1|          CGEYRMFFQIALPTMLPAIGAVGIFLFTHQWNNFLWPLVVIVTEDMYTLPIVLSIL---G
ref|YP_001546403.1|       AGEWRVFTSVALPTMRPTLAALAIYSFMFQWNSFFWPLIIMRDKAMETLPVRINAL---V
ref|ZP_02016964.1|        ATEFQIFYRIALPTMRSSLAALAIILFLFQWDLFLYPLVILETADMYTIPIGLAQL---T
ref|ZP_01188237.1|        AGEFEIYYKIALPLSKPGMATLGILTFLGSWNNFMGPLLVLQEKTKYTIPVALSKLN--G
RAAC02615                 ASEFYTFFRIVMPNMLPSMAALGILTFLQQWGNFIWPLIVINSRNMSTVPLMLEQLD---
                           . *:  :  : :*    .  :.::.*  *  .*. *: **  :            *:*: :  * ref|ZP_02171438.1|        GMSR-IDYGQIMLGTTLSTLPIMIFFLLLQKQFISGILGGSVK-
ref|YP_176793.1|          GQDN-LDYGQLMLAATISVLPIFIMFLFLQRYFIAGISSGAVK-
ref|YP_001546403.1|       GLSI-IDYGQLMMGTALTTLPIMMIFIAFQRQFISGALAGAVKG
ref|ZP_02016964.1|        GFQR-IYYDQIMVAATLAIVPMVVLFLVLQKQFVSGILAGSLK-
ref|ZP_01188237.1|        NFET--PWGATMMGTALGVFPIVLAFVLASKYFISGLTTGATKG
RAAC02615                 QPGNVIHYGPIFAGAAIGLVPLMIVFVALQRYFISGMYSGSVKG
                            :.    : .::: .*:..: *:    .: *::*   *: *
```

FIG. 41

```
ref|YP_147766.1|        ------------------------------------------------YVM
ref|YP_001125909.1|     ------------------------------------------------YVM
ref|NP_244315.1|        ------------------------------------------------YMM
ref|YP_077677.1|        ------------------------------------------------YVM
ref|YP_001179080.1|     ------------------------------------------------YYM
RAAC02733               MKRFNWKSGKKYAAVAAAAASIVLAATGCSTGGGNSSTSSGSTGGSSSAFQGSSSETYYM
                                                                        * * ref|YP_147766.1|        VTFQSGMDYWKRCLKGFEDAAEEALNVSVEYRGATQYDVNEQVTVLEQVIARKPAGIAVSA
ref|YP_001125909.1|     ITFQSGMDYWKRCLKGFEDAAEELNVSVEYRGATQYDVNEQVTVLEQVIARKPAGIAISA
ref|NP_244315.1|        ITFQSGMDYWKRCLKGFEDAAQALNVTVEYRGAAQYDIQEQITVLEQAIAKNPAGIAISA
ref|YP_077677.1|        VTFQSGIEYWKSGLKGFEDAAQLFNVSVEYRGAAHYDVHEQTTVLEQVIAKKPAGIAVSA
ref|YP_001179080.1|     VTFASGIEYWKGCFKGMKAAADLYGVKAIYTGAPQFDVNQQVTVLRQVIAKKPAGILVTC
RAAC02733               VTFLSGIEYWKGCFAGMQAAAKDLGVKAVFTGAPQYDINQEVTTMQQVIAKHPAGILVTS
                        :** **:;***   : *:: **.  .*.. : **.::*::::  *.:.*.**::**** ::.

ref|YP_147766.1|        INPTALTKTINKAVEEGIPVVLFDSNASGSKAFSFLGTNNYSAGVTAAHEMAKLLKNEGK
ref|YP_001125909.1|     INPTALTKTINKAVEKGIPVVLFDSNASGSKAFSFLGTNNYNAGVTAAHEMAKLLGNKGN
ref|NP_244315.1|        IDPVELTDTINKAVDAGIPIVLFDSGAPDSHAHSFLGTNNYNAGMNAAYKMAELLDGEGE
ref|YP_077677.1|        INPKALNPVIDKAHEQGIPIVLFDSDAPLSKASTYIGTNNMEAGAVAARRMAEFLNGKGE
ref|YP_001179080.1|     ANPDALKAPIDEAIKKGIPVITFDADSPKSLRYSVLETGNYNAGAMAARYLGKLLGGKGE
RAAC02733               INAQAMTPVINQAIAAGIPVISFDSDAPQSKRYAYLGTSNIEAGQKAADYLGQALGGHGE
                         :.    :.   *::*   ***::  **:..   *    :  :  *.*  .**  ** ** ::  *  ..*:

ref|YP_147766.1|        VAIITSPHQLNHQERTRGFVETIYQKYPRMQVVAVKNGKGDAMASKQAAMEILKDYPDVQ
ref|YP_001125909.1|     VGIITSPYQLNHQERTRGFVETIYQKYPQMHVVAVKNGKGDVRASKQAAIEILKDYPDVQ
ref|NP_244315.1|        VAVITLPNQLNHQERTTGFKETLEAEFPAIEVIAVEDGRGDSLHSRRVAHQLLEDYPNLA
ref|YP_077677.1|        TAVITQPQQYNHQERTKGFEQTIKQKYPNMKVAAVLDGKGDELTSKKEAAKILEENPSIK
ref|YP_001179080.1|     VGISTVAAQLNHEQRKQGFIDTLKKEFPGIKVVSIVNDENDSTKAARGVAAMLQAHPNIK
RAAC02733               VAVITTPGELNLDQRVQGFKDEMAAKYPGVKVVAVQNGNSDQIKTAQVTSALLQTYPNLA
                        ..: *  . : *  ::* ** :  : ::* :.* ::  :...*   :  :  .  :*: *.:

ref|YP_147766.1|        GIFATEANGGVGMAEAVKELNKK-EIKLISFDTEKQTLDLVKGGVIAATLAQGTWNMGYW
ref|YP_001125909.1|     GIFATEANGGVGMAEAVVMLNKK-HVKLISFDTEKQTLDLVKKGVIAATLAQGTWNMGYW
ref|NP_244315.1|        GIFATEANGGVGVGDAVRLESRAGEIQIISFDTDKGTLDLVDEGIISATLAQGTWNMGYW
ref|YP_077677.1|        GIFTTEANGASGVARAVKEAGLEGEVCIIGFDKDKKTLDGIKNGSISATMSQDTWQMGYW
ref|YP_001179080.1|     GIFCTDAPGGVGVATAIKEANKVGKIKIVSFDTDKGTLDLIKQGVIDASIAQGTWNMGFW
RAAC02733               GIFCTEADEGTGAATAVQEAGKTGTVKIVSFDTDKATLNAIKSGQITATVAQGTWNMGFW
                        ***  *:*  . * . *:       :  ::.**.:* **: :. *  *  *:::*.::* ref|YP_147766.1|        SLQFLFHLHHHL----TSP----SRSGDSPLPTYVDTGITVVTRENVDHF---
ref|YP_001125909.1|     SLQFLFQLHHRL----TSS----SRSGDLPLPVYVDTGITVVTKENVDRF---
ref|NP_244315.1|        SLTYLFHLHHGL----TEPQI-LQTREEAPLPLYVDTGITIVTDENVDYY---
ref|YP_077677.1|        SLHMLFFSNHHL----KHE--------RPLPAAIDTGITIITKENVAAY---
ref|YP_001179080.1|     GMTFLFYLKHGI----VNPVDNWKKFGINPLPPYVDTGTMVVTKQNVDAF---
RAAC02733               GLMDLFAIHHNL----VHPVANWQQSGVDPVPPEVDTGVTIVTKSNVNAYLQQ
                        .:  ** :* :              *:*  :*** ::* .**  :
```

FIG. 42

```
ref|YP_001179079.1|   ------------------------------------------------------------
RAAC02734             MTKPSWSTHLACTRKLLWGENMQPVDTAPVNIDKERETWLRRVARIRELTIVLVIVALCI
ref|YP_001036823.1|   ------------------------------------------------------------
ref|YP_001312352.1|   ------------------------VDILPVAHDARRPAW-KRIGTMREAGLIAIILSLCV
ref|NP_437024.1|      ------------------------VDTLAVAQKTRRPTW-KRIGTMREAGLIAIILSLSV
ref|YP_471845.1|      ------------------------------RTSSF-KRIATMREAGLIAIILALGI ref|YP_001179079.1|   ------------ENLITTALGLAADGILAIGMTIVLVSGGVDLSVGSVLGLSAVIAGGLY
RAAC02734             ILSFMSSSFLSVDNIVTTILSIVMTAIVSVGMTVALVSGGFDLSVGSVMSMAGVVTGSLA
ref|YP_001036823.1|   ------------NNMRSIALSVSVDGLFAIGLTMALILGGIELSVGSVAAMTCVITGYLA
ref|YP_001312352.1|   IMSFASPHFLTLGNFRAMLMSFSVEGIVVVGMTILLIVGGIDLSVGSVVCFSMVLSGSLF
ref|NP_437024.1|      IMSFASPHFLTLGNFRAMLMSFSVEGIVVVGMTILLIVGGIDLSVGSVVCFSMVLSGSLF
ref|YP_471845.1|      VMSFASPHFLTLGNFRAMLMSFSVEGIVVVGMTILLIVGGIDLAVGSVVCFAMVLSGSLF
                                *:  :    .:. :*:*: *: **.:*:****  :: *::* * ref|YP_001179079.1|   LSFGVNIWIGSLIALIVCALIGLFNGYFIARVGIPPLIVTLAMMGIARGAAYVLTQGSPL
RAAC02734             LN-GVNIWLAAIFGLLASLCSGLITGLFIGKVKINPFIMTLGMQGVVQGVAYVVTQGAPL
ref|YP_001036823.1|   LQ-GVNIWVACIASIASGLVVGLFNGFMISKIGLPPFIVTLGMENLARGMAYIITTGSPL
ref|YP_001312352.1|   LM-GVDPWTASLVGIAASAAIGCIMGFFVTVVGLNHFITSLAAMVIVRGLCLVITKGTPL
ref|NP_437024.1|      LM-GVDPWTASLVGIAASAAIGCIMGFFVTVVGLNHFITSLAAMVIVRGLCLVITKGTPL
ref|YP_471845.1|      LA-GLDPWTASLAGILASSAIGAIMGFFVTVVGLNHFITSLAGMVIVRGLCLIITKGTPL
                      *  *::  *  ..:  .:     *   : ::    : :   :* :*.   :.:* . ::* *:**

ref|YP_001179079.1|   ALYG-NLKGFDFLGQGKILGIPFFIVFFIFLIILFDFLMRKSAPFRLVYYVGSNENAAKL
RAAC02734             SVTG-VPKSFLYLGQGNLLGIPVLIWILAVVVVVSDFIMRRAVVARKVYYIGSNEAAAYL
ref|YP_001036823.1|   SVSGYLPQSFRFFATGSVFGIPVLFIIFIIISAIAFIFMKYSKICRNIYYVGSNENAARL
ref|YP_001312352.1|   SLFT-LPPAFKAVGQGTFFGVPYVIVIFIAVVAVFDFLLRRATAFRKVFYTGSNEKAALY
ref|NP_437024.1|      SLFT-LPPAFKAVGQGTFFGVPYVILIFIAVVGAFDFLLRRATAFRKVFYTGSNEKAALY
ref|YP_471845.1|      SLFT-LPAGFKAVGQGTFYGIPYVILIFVAVVMLFDFLLRRATAFRKVFYTGSNEKAALY
                      :: .*  .. *..  *:*  .: ::   :    ::::  :   * ::* ** ref|YP_001179079.1|   SGINVPNVKISVYVLMSVLAGIAGIFTLSRFSVAAPTAGNGSELNAISACVIGGASLAGG
RAAC02734             SGIRVSKVKVWIYIFTALLAGIAGILTLSRFSVAAPTAGQGMELQAIAACIIGGASLTGG
ref|YP_001036823.1|   SGINVDRVKIGVYVTIALISTLAGLLSLARFNVATPELSKGAETTAISAAVIGGTSMTGG
ref|YP_001312352.1|   SGIKTKDVKFWVTVLCTTLSGVAGTIYMARFGAATPTFGVGMELNIIAAAVIGGASLNGG
ref|NP_437024.1|      SGIKTKDVKFWVTVLCATLSGVAGTIYMSRFGAATPTFGVGMELNIIAAAVIGGASLNGG
ref|YP_471845.1|      SGIKTNQVKFWVTVLCSTLAGVAGVIYMSRFGAATPTFGVGMELNIIAAAVIGGASLNGG
                      *.. .  :  :   : ::  :  ::..*:*   . *  *   *:*.:***:*  ** ref|YP_001179079.1|   EGTVLGAILGTILVGIINNALVLLNVSVYWQNLVSGLILIAAVTIDYLTHQKKS-
RAAC02734             EGTVLGALLGSVLVGIVNDALVLLNVSVYWQSLVTGFVLIAAVTLDVLTHRKKAN
ref|YP_001036823.1|   SGGVLGTVLGIFLLKIVNSALVMMNVSVYWQEFVQGAILVLAVTIDYLSHRK---
ref|YP_001312352.1|   SGTILGAILGIALLSVVTSSLILLDVSVYWQDMIKGCILLAAVSIDHMLHKRKA-
ref|NP_437024.1|      SGTILGAILGIALLSVVTSSLILLDVSVYWQDMIKGCILLAAVSIDHLLNKRKA-
ref|YP_471845.1|      SGTILGAILGIALLSLVTSSLILLNVSVYWQDMIKGCILLAAVSIDHFLHKRKA-
                      .*  :**::**  *: ::.. :*:::::******.::   *  *:  **::*   :  :::
```

FIG. 43

```
ref|YP_001547100.1|    -----------------------------TAPTTGTGGTTSSGGKVV--------ALFLPDA
ref|ZP_01464237.1|     ------------------------------------------KIA---------LLLPES
ref|YP_001509451.1|    -------------------------------------------IA---------LLLPET
ref|YP_001235093.1|    -----------------------GLTAAHAQSVTQP-SVHQISSK-KTTIAFLLPE-
RAAC04053              MAKKTWKKSATWMAAAAVVTGIVAGCGTSSANGQGSTSTGAASAVNPHPSVKIAFLMPET
ref|YP_430861.1|       --------------------------GQGGNSSKNGGNQGASAKNGD--KIKIGLSMDDL
                                                                     : :  :

ref|YP_001547100.1|    KTA-RYETADRPYFEAKMKELCPDCQVIYNNANQDASLQLQQAEAALTNGAKVLVLDPVD
ref|ZP_01464237.1|     KTS-RYESHDRPHFERKVKELCPDCEVIYSNADQDASKQQSQTEAALTNGAQVLVLDPVD
ref|YP_001509451.1|    QTT-RYESADRPYFEARMAKICPDCKVLYSNADQDSAAQQNQAEQAMTNGAKVLVLDPVD
ref|YP_001235093.1|    NSSPRYEQVDRPWFIKMAHAADPNAKLIVSNANSSPDTQLNQAESAISNGADVLVVDPVD
RAAC04053              NTSPRWEYDDRPDFIAAMKKLDPNAQIIYANAQGSEATQLQQVESAITEGAKLLVVAPVN
ref|YP_430861.1|       RQE-RWQHD-RDLFVAKAKEL--GAEVLVQSANGDDATQLSQAENLISQGINVLVVIPHN
                        .  *::  *   *        ..::: .*:  .   * .*.*  :::*  .:**: * :

ref|YP_001547100.1|    SAAAASIADKAKAQNVPVIAYDRLILNSDGVSYYISFDNESVGKLQAESLVAQLDKQGIA
ref|ZP_01464237.1|     SASAAAMVARARQSKVPVISYDRLITNSD-VDYYISFDNEKVGKLQGQALLDKLKADGKD
ref|YP_001509451.1|    GEAAAVIARNARDRGVRVVSYDRLIQKAP-VDAYISFDNEKVGQLQGQALLDAIG-DRAG
ref|YP_001235093.1|    GKAGAAIVNYAARNHVKVISYDRLIQDSK-PDYYVSFDNTKVGELQGEYIAKHTK----P
RAAC04053              GFAATTIVTEAAKAHVPVISYDRLIQNAK-VDYYVSFNNVEVGKLQGEYIAQHTK----K
ref|YP_430861.1|       GDAMAPIVEAAHKAGVKVLAYDRLIRNAD-VDLYISFDNVRVGELQAEYLTKKVP----K
                           : : :. *   *  *::*****  .: . *:**:*  **:**.: :

ref|YP_001547100.1|    NPTIVMINGSPTDNNAKLFKAGAHSVFDPLVSAGKLTIANEYDTPDWSPDKAQDQMQQAL
ref|ZP_01464237.1|     KGTIVIINGAPTDNNAKLFKAGAHSILD----GSGLVVGAEYDTPDWSPDKAQQQMEQAV
ref|YP_001509451.1|    AGKVIMINGSQDDPNAQQFKDGALSVLE-----GKVTIGFDTFTPDWSPDTAGREMDQAI
ref|YP_001235093.1|    GGSVMMINGAPTDPNAFDFRKGAMNVLGPLFKSGKLHLAYSVMTPDWSPQNAFEESQQAL
RAAC04053              GGTVVMLDGAPTDPNAKQFAQGAHDVLDPLFKSGKLKLGYEQFTPNWDSQQALTEMQQAL
ref|YP_430861.1|       GKYFLM-GGSPTDNNAKLFRQGQMNVLKPLIDKGDIKVVGDQWVKDWLPEEAMKIMENAL
                             .:: .*:   *  **  *  *  .::       . :  . .:*  .:  *    ::*:

ref|YP_001547100.1|    TSMG-NKVDGVYAANDGTGGGAIAAMKAGGLSPLPPVTGQDAELAAIQRI-LAGDQYMTV
ref|ZP_01464237.1|     TSLGKDKIVGVYAANDGTAGGAIAAMKAAGVNPLPPVTGQDAELAGIQRVLV-GEQYMTV
ref|YP_001509451.1|    TTVGRENIVGVYAANDGMAGAVVAALRRANVNPLPPVTGQDAELAGVQRV-LAGDQHMTV
ref|YP_001235093.1|    TRLH-NKVNAVLAANDGTASGVIRALQAVGLAGKVPVTGQDATNGGLTFI-LEGLQSMTV
RAAC04053              TRLH-NHVDAVLAANDNLAGAATEQQHIKG-IPVTGQDTDAGLHRIYYEGTQSMTV
ref|YP_430861.1|       TSNN-NQIDAVVASNDSTAGGAIQALAAQNLAGKVAISGQDADLAACQRIV-EGTQSMTV
                       *    ::: .* :. .....: *:   :    .::****   ..   :   * * *** ref|YP_001547100.1|    YKAIKPQAEAAAELAFALLEGK--TSDKATSKVNNGKIDVPSILLTPIAVTKENVKDTIV
ref|ZP_01464237.1|     YKAIKPEAEAAAELAVALLRGQVPEGKV-NAKVNNGQKDVPSILLPPVSVTKENVKSTIV
ref|YP_001509451.1|    YKAIRPEAEQAADLALALLRG-EPVDTIATGHVDNGNGQVPAVLLEPVAVTRDTVAATVV
ref|YP_001235093.1|    FKYVPEEAAAAAELAVAVATDTKPPAGLLNGKTNNKMIDVPSVLLKPLVVTKANIAGSVI
RAAC04053              YKPIKEEANAAAQLAYDLITGKKPPASLVNGTVNNGATNVPSVLLQPIVVTKSNVASTVI
ref|YP_430861.1|       YKPITTLATRAAEVAVALAKGENIGAN---NKVNNGKIDVPSVLLTPIMVDKDNMVQTVI
                       :* : * **::*  :  .         .:*   :**::** *:  * .:   :::

ref|YP_001547100.1|    KDQF--------------
ref|ZP_01464237.1|     ADGF--------------
ref|YP_001509451.1|    KDGF--------------
ref|YP_001235093.1|    KSGYTTWKAICVGPAAQ-
RAAC04053              KDGFTTWARIKN-PAEQQ
ref|YP_430861.1|       KDGF--------------
                        . :
```

FIG. 44

```
ref|YP_001547099.1|            -ATEA-AMPVLQLRQISKRFGAVQALSNVDFEVYSNEVVALVGDNGAGKS
gb|AAK01295.1|AF332585_1       -ASSSSTRPTLELRNICKSFGGVQALKNVDFEVYAGEVVGLVGDNGAGKS
ref|YP_289977.1|               -------QPILELSGISKRFGAVQALSDVDLTVHAGEVVALLGDNGAGKS
ref|NP_823422.1|               ----VSATPVLALRGVSKRFGAVQALTDVELEIHAGEVVALVGDNGAGKS
ref|YP_001235092.1|            IAAEPAAAPLLEVRGLQKRYGAVVALRDVNFTVRRGEVTALLGDNGAGKS
RAAC04054                      MATEVKTQPVLEVRSLRKRFGAVQALDGVSFSVHAGEIVALVGDNGAGKS
                                 * *  :   : * :*.* **  .*.: :   .*:..*:******** ref|YP_001547099.1|            TLIKTIAGAYKPDEGDYVFEGKVVSINSPRDATDLGVETVYQDLALCDNL
gb|AAK01295.1|AF332585_1       TLVKTMSGAYVPDSGEIFLNGERVSIASPQDATRLGIETVYQDLALCDNL
ref|YP_289977.1|               TLVKVIAGVNPADSGTILWEGKPVQINRPSDAQQLGIATIYQDLALCDNL
ref|NP_823422.1|               TLVKTIAGVHPIDEGVIEWDGKAVQINKPHDAQNLGIATVYQDLALCDNI
ref|YP_001235092.1|            TTIKAIAGVAPIDEGEILLEGRPVSIRHPSEATALGIQTVYQDLALCDNL
RAAC04054                      TTIKMIAGVEQPDEGEILFEGQPVRLTSPAVAEKYGIQTVYQDLALCDNL
                               * :*  ::*.    *.*    :*. * :  *    *: *:*********:

ref|YP_001547099.1|            DVVSNLYLGRENVRRS---GLKSF---DLLNETEMERRATEVLRDLSVKI
gb|AAK01295.1|AF332585_1       DVVGNLWLGREAYRWL---IPGVL---KVLDETEMERRTIEVLKLLDVKI
ref|YP_289977.1|               DIVANLFLGTERT------ALGV------LDELEMERRAHELLDSLSVRI
ref|NP_823422.1|               DVVGNLYLGRELR------KRGI------LDEVEMERRSRELLTTLSIRI
ref|YP_001235092.1|            GICANLYLGRELVSTPTALGPHVLR---DVD---MELEARRVLKTLRINL
RAAC04054                      DIVSNLFLGRELRRS---VIPGLVR---VIDRNEMERRAIPVLNELGIRL
                                .: .**:** *                 ::   ** .:  :*  * :.:

ref|YP_001547099.1|            PSVRVQIANLSGGQRQSVAVARSVMWNSKVVLLDEPTAALGVEQTRQVKD
gb|AAK01295.1|AF332585_1       PSVRRPVAALSGGQRQCIAVAKTILRSPKVVLLDEPTAALGVAQTRQVLN
ref|YP_289977.1|               PNLRIPVAALSGGQRQIIAIARSLLGDPKVVMLDEPTAALGVAQTAQVLD
ref|NP_823422.1|               PSVRIPIASLSGGQRQTVAIARSMLGEPKLVILDEPTAALGVEQTAQVLD
ref|YP_001235092.1|            PALDTPVASLSGGQRQAVAIARAVLWDSKLVIMDEPTAALGVAQTAEVLR
RAAC04054                      PPLHTQVASLSGGQRQTVAVARSVLWGSKLVMLDEPTAALGVVQQRAVLE
                               *  :     :* ****** :*:*:::  .*:*::********* *    * ref|YP_001547099.1|            LIMRLRDRGLAVVVISHNVADVFEVSDRIIVMRLGRRVATFHTARSTNEQ
gb|AAK01295.1|AF332585_1       LIQRLKQQGLAVVVISHNLHDVFEVCDRVIVMRLGQRSATFDIQSSTSEQ
ref|YP_289977.1|               LIERLRDQGLGVILISHNMADVRAVADRAVVLRLGRNAGDFRIEDTSYEE
ref|NP_823422.1|               LVERLRERGHAVILISHNMADVKAVADKVAVLRLGRNNGVFEVKSTSQEE
ref|YP_001235092.1|            LVRDLAEQGYGVILITHNMQNVFQVADNIAVLRLGATVMEARKSDVTPEQ
RAAC04054                      LIQRLAASGRAVLVISHNMSDVFKIANRIVVLRLGRTVATFDREQVTPEQ
                               *:   *  *   *.*::*:**: :*  :.:.   *:***         :  *:

ref|YP_001547099.1|            VIGAITGA--------
gb|AAK01295.1|AF332585_1       VVAAITGAEYRD----
ref|YP_289977.1|               IVAAITGAA-------
ref|NP_823422.1|               IISAITGAT-------
ref|YP_001235092.1|            VVGAITGTLA------
RAAC04054                      VVAAITGASAQEEVTS
                               ::.****:
```

FIG. 45

```
ref|ZP_01464218.1|      ----------------------RLSQGELGSLPVIIGLCVIWLIFYIANDRFLSAVNLT
ref|YP_001509449.1|     ---------------------SALRHVRAGELGSLPVIVGLVVIWTIFQFQNSNFLTSYNLT
ref|YP_001547098.1|     ----------------------ERFRQGNLGSLPVIIGLIIIALVFQSINKNFLTPLNLT
ref|YP_289976.1|        ----------------------RLRSGELGPLPVLVGLIVIAGVFWSLNPKFLTAQNLS
ref|YP_001235091.1|     -------------------------LPVIAALIVIWIVFETLNANFLTPRNLS
RAAC04055               MTVNIGQAKQTQTPAARSTSVFDRIIGGEFQQLPVFLSLVLIWIVFEILNNSFLTSRNLS
                                                             ***:  .*  :*   :*   *   **:. **:

ref|ZP_01464218.1|      NLMLQITAMGTISAGIVLVLLLGDIDLSAGAVSGLSAAVMAXLNVKMGYGAVPSLLAGLA
ref|YP_001509449.1|     NLALQVAATGTIATGVFLVLLLGEIDLSVGWVSGLCASVMAVLSVRHGWAPVLAIVAALV
ref|YP_001547098.1|     NLMVQIAAMGTISTGVVLILLLGEVDLSAGQVSGLAAAVMAVLSVRHNLPAAVAIIGAIV
ref|YP_289976.1|        NLTLQIVAVGFMACGVIMVLLLGEIDLSVGSVAGVCGVIVTLLAVNYQWNEIAAIVVAIL
ref|YP_001235091.1|     NLAAQIVVTGTLALAEIYIILLGMIDLSIGWNSVLAASVFSLATVFFHLPVGVGIVLGIA
RAAC04055               NLVLQMAEYGLLGVGETLILLLGEIDLSIAAVSAIGGAILAVLAGNGVNPY-VAILAGAL
                         **   *:.   *  :. .    ::*** :*** .   :  :  .  :.:      .:: .

ref|ZP_01464218.1|      TGAAIGAFHGLWMTRFRVPPFVVTLAGLLGWQGAQLFVLGNTGTVNLN-DSFIIGLAGTF
ref|YP_001509449.1|     VGVAVGALQGSLFAVFGVPSFVVTLAGFIAWQGVQLKVLGRDGSLNLP-DSEITKLTSTF
ref|YP_001547098.1|     VGALVGLLQGWWISTFRVPSFVVTLAGLLAWQGSRLRVLGDTGSINIT-NKFINDIANYK
ref|YP_289976.1|        AGTLIGTLHGTIFAKIGVPAFVVTLAGLIGWQGAQLYLLGPEGTINVPYNGLIGAITHTY
ref|YP_001235091.1|     LATGLGFLQGMVVSRIGVPSFVVTLGGGMIAEGLTLAILTPHGGSVPLADNFTTAIGTLN
RAAC04055               SGTVLGLFQGFWVTVLRVPSFIVTLAGSLAFLGLLFVLIGQEG-TVPIMNNTINAIAGNY
                         ..   :*  ::*   .:  :  **.*:***.*  :    *    :  ::    *           :                :

ref|ZP_01464218.1|      FEPAIAWLVVALIVVVHVATVFVERRRREAAGLPLVPLRSTVVRMVFTHGALVAAVAVFT
ref|YP_001509449.1|     FTDATGWVIAGIAVAGYAGAQLAEVRGRRRAGLRPRPIAEVAVRVVVVGGALIAAVAILN
ref|YP_001547098.1|     LPIWLGWVLGIVSVVVYTLIVFNEYRSRRAAELPTGSLNGVFWRVGVVGASVLAGVAMMS
ref|YP_289976.1|        LVPAVGWGIGITAVALYGLISVRGARRRAAAGLPAKSVTEIGVRTALLALPVLGGVWVLN
ref|YP_001235091.1|     LDPLWSWVLSLLLFGAYAAVTLNGIRKRTASG--HEGGFAATMRLVGVAIMLFGAVFMLN
RAAC04055               LPDWLSWVLVAVALLLMVWTAVRDRAKRQKLGLPPKSAVSTWTKLILSAAVMIGATVLLN
                         :     .*  :       .      *           :                   :.... ::.

ref|ZP_01464218.1|      QDR---------GLPLAALIFGGVVLLLELLIRHTRFGRHTFAVGGNAEAARRAGIRVD
ref|YP_001509449.1|     DDR---------GLPLALLIFGCLVLLVDLVSRRTSYGRHLYAVGGNVEAARRAGINVR
ref|YP_001547098.1|     VNRNANAAGNPIQGVPSAVIIFLTFLIIFDFITQRTRFGRYVYAVGGNTEAARRAGINVN
ref|YP_289976.1|        SFR---------GVPVAFLLFVGVVVLFDLILRKTRYGRMVFAVGGSAEAARRAGINVD
ref|YP_001235091.1|     AYR---------GVPFLLMIFLIALFASAFVTKSTRFGRHLYAVGGSAEAARRAGISVK
RAAC04055               AYQ---------GVPIAGLVLIVFVVLLAWICQSTAFGRHIYAVGGNAEAARRAGINVK
                         :         *:*    :::   :.        :  :    :..******   * ref|ZP_01464218.1|      RIRVTIFTLASTMAAAGGILAASRLLAVNQSSGSGDVLLNAIAAAVIGGTSLFGGRGSAW
ref|YP_001509449.1|     ALRVSAFAAASCLAGVGGVLAAARLTSVTQASGGSDTLLNAIAAAVIGGTSLFGGRGRAW
ref|YP_001547098.1|     RIRITIFMLASALAACGGILAASRLNAANQSSGDGDVLLNAIAAAVIGGTSLFGGRGRIW
ref|YP_289976.1|        LIRISVFALASTLAGVGGILLVSRSYAVNQLTGGGDDLMMAIAAAVIGGTSLFGGRGSAY
ref|YP_001235091.1|     GIQLAVFIIAGFLVGLAGYLDAARLGVASASVGNGDIMLNAVAAAVIGGTSLFGGRGSVY
RAAC04055               GVRIMVFTLAGTMAAIGGIVGASRLGAASTASGGSDLLMDSIAAAVIGGTSLFGGYGSVW
                         :::    *  *. ..  .*  :  :* ..    *..*  :: ::**************   *   :

ref|ZP_01464218.1|      SALLGALVIGSISNGMDLLALSSSVKFMVTGAVLLVAASIDALSRRGRQAAGR
ref|YP_001509449.1|     SALLGILVIGSIANGMDLLGLDQSVKFIITGSVLLAAVLLDAAARRGRQASGR
ref|YP_001547098.1|     SALLGALVIGAIANGMDLLALKSSIKFIVTGSVLLLAVTIDAASRARRENSGR
ref|YP_289976.1|        SALLGGLVLGAISSGLYLLQMDSSVRFMITAVVLLVAVILDAVSRRTRKAHAR
ref|YP_001235091.1|     GALFGALVIASVSNGMNLLGAASSVRFIVEGLILLAAITIDTILRLRRMRSGR
RAAC04055               NALLGALVIGSIENGMALLNAPTSTKYLVEGAILLLAVTFDTFTRMRRKQLGR
                         .**:* **:.::  .*: **       *   *  ::::  .  :** *  :*:    *    *   .*
```

FIG. 46A

```
ref|NP_343451.1|          ---------AGEAIARMDRIPIWGLSYIFIGILGIGFLFTFYDIFDINVSFIQTALTLFH
ref|YP_256381.1|          ---------AGEIIARMDRIPIWGLSYIFIGILGIGFLFTFYDIFDINVSFIQTAVTIFH
ref|YP_001191851.1|       --------NASEIIARLDRLPVWSLPATFIAVLGTGFLFTFFDIFDINVSFIQTALTTFG
ref|NP_376612.1|          -------TKSSEIIARLDRLPTWAFNYILLGIIGVGELFTFYDIFNINVSFVQTAVTLFH
ref|YP_001234214.1|       -------NTAGLLLARLDRIPNWTLPRLYALVIGIGFLFTFYDIFDINVSFIQTCMALVP
RAAC03004                 MGTGVPVSSAAGILARMERLTAWPLPRRLFLVIGLGYLFTFYDIFDVNVSFVQTATSIIP
                                   :.  :**::*:. * :     ::*   * ****:***::****:**.  :  .

ref|NP_343451.1|          VSNPTSPQIPALLGPIVLLNLVGYIIGALILSPISDVIGRRRMLMITMIITGLGSLYNAL
ref|YP_256381.1|          VSSPSSPQIPLLLGPAVLLNLIGYVIGSLVLSPVSDIIGRRRMLMITMIITGLGSLYNTF
ref|YP_001191851.1|       VSSPSSPEIPQLLGPVVLWNLVGYVIGALALTPLADRYGRKRMLMITMAITGLGSLYNAL
ref|NP_376612.1|          ---VSPAQAAQLLGPVVLGNLVGYVVGSLVLSPIADRIGRRDMLMITMLIMGLSSLYNAF
ref|YP_001234214.1|       --GCTPAKSGAYIGLPVLLNLAGYVVGTLVLSPLADRMGRRDLLLVTMILTGIGSALTAI
RAAC03004                 --GATPADASRYIGLPIFANLLGYVVGTLVLSPLADRVGRRRMLMTTMFITGVGSLLTAL
                                :...    :*   ::  **  **::*:*  *:*:;:*   **: :*: **  :  *:.*   .::

ref|NP_343451.1|          ANNYVNFLVARTITGIGVGADLAIVNTYIGEVAPINGRARYTSLVFLFSTLGATLGIWLG
ref|YP_256381.1|          VNDYLNFVMARTITGIGVGADLAIVNTYIGEVAPTNGRAKYTSLVFLFSTLGATLGIWLG
ref|YP_001191851.1|       SPDYLNYLLARTITGIGVGADLAIVNTYINEVSPVNGRAKFTSLVFLFATLGAFLGLWLG
ref|NP_376612.1|          APNYINFFIARTLTGIGVGADLAIVNTYISEVAPLAYRSKYVSAIFIFSTVGGFLAIWLG
ref|YP_001234214.1|       VQSYGTFVAARAFTGVGIGADLAIVNTYIGELAPAGGRARYTSMIFIFSALGAVAGIWLG
RAAC03004                 AMRDWWFILARGITGVGVAADLAVVNTYMSEVAPRRARAKYTSGLFIFSGVGALVGIWLG
                           :.   ::*:.**:**:.*::*    *:::.* :*:*;*: :*.  ..:*** ref|NP_343451.1|          LFLTTPSAPFPLGLPFALGGSGFFAVNGWRVMYGIGALLALIGLLLRFSLPESPRWLISK
ref|YP_256381.1|          LLLTTPPAPFPLGLPFALGLSGFFAVNGWRVMYGIGALLALVGLLLRFSLPESPRWLISR
ref|YP_001191851.1|       LLITTPPAPFPLGLPFALGTTGIFATAGWRIMYGIGSLLALIGLLLRVELPESPRWLASK
ref|NP_376612.1|          LLFTTPPAPFPQGLPIALGGSGFFAINGWRVMYVIGAVLALIGLALRFRLPESPRWLISK
ref|YP_001234214.1|       LWLTTPPTPLPLGLPFALAGKGFP--DGWRVMYLIGAALALVGVLLRFQLPESPRWLIAQ
RAAC03004                 LWLTTPSAPFPEGLPFALATSSFH--WGWRLMYYIGAVLALIALLLRLELPESPRWLAAK
                          *  :***.:*:* ***:**.   ..:    ***:** **:  ***:.: **. ******* ::

ref|NP_343451.1|          GKLTE------------AERIVEVMEKK-------ATGKLGNLPPLPNIIQPYIAERYS
ref|YP_256381.1|          NRISE------------AEKIVNMMEDK-------ATKKLKQLPSLPKVITPYLSEMLS
ref|YP_001191851.1|       GRIME------------ASKIVERMEEA-------ARKKIGELPPVPQHIEVKTITEVS
ref|NP_376612.1|          GRVSE------------AEMIVNLMEEK-------VTSRGYKLPPLPSLIPIYKASKP-
ref|YP_001234214.1|       GRLEE------------AGQVVADMEARA----------HAIFPLPPLPERLPPAPRRE
RAAC03004                 GRVEE------------AAAVVAAMEERLG---------LGAFQSDGTAASFSLVS--D
                          .::   *             *  :*   **                    :

ref|NP_343451.1|          YLDALKTIFSSSLYIKRFGILVSMWLFGYMTVYTLAAGLTSVLASLGFAPPEAGMIAAIG
ref|YP_256381.1|          YADTLKTIFSNSQYVKRFVILFTMWLFGYMTVYTLAAGLTSVLASLGYPPPEAGIIAAMG
ref|YP_001191851.1|       YKEALRTILGNRVYLKRWIIVMSMWFFGYITVYTNAAGLTTILSSLGYPSSEAGMIASLG
ref|NP_376612.1|          --VPYSEIFTNSTYLKRFITLVIVWFLAYTTVYSIAAGLTSLLTAQGYSTSEAGMISAIG
ref|YP_001234214.1|       EAMPFSAIFRNATYRNRTLLLTVMWFLAYITVYSFAAGFTTLLAALHYPPEAGLITAMG
RAAC03004                 TRAPYGELFGSPVYRRRIFLLFFVWLFSYVTVYGFSAGMTTLLVGAGYAPSEAGLIVAVG
                                  . :: . * .*     :    :*::.* *   ::*:*  .  :...***:*  ::* ref|NP_343451.1|          VIGFILVPITTFFVGDRLERKTWTVISVVFTIIGGLLIAIAGTNIALSFLGSIILFYGFN
ref|YP_256381.1|          SIGFILVPLTTFAVGDRLERKVWTAISVIFTFLGGLLIALAGTNVVVSFIGSIILFYGFN
ref|YP_001191851.1|       ILGFVAVPVLLILFGDRLERKVWVPISAVIMLLGGAIMAEAGHNFFLEVLGAFVLFFGNN
ref|NP_376612.1|          IIGFILAAVIATLFGDRLERKWWIGIGALVTVIGGMMVALTPNPI-IDGLGAIILFIGFN
ref|YP_001234214.1|       TFGFVLCAIVAYVWGERMERRRWTPLAALITLGGGVLIALGGQTLWLSVIGAMIVFFGFN
RAAC03004                 VLGMLLAGVVAYLAGEVMERKTYLLVSAVLTILGGLVVGLAGHHLWLSYLGAILLFFGQN
                           :*::   :   *:  :**:   :   :...:.  . **   :::.   . :..  :*:::**  *  *
```

FIG. 46B

```
ref|NP_343451.1|        LWVPTSYAWTAESFPTRARSTGFALCDGVGHIGGGIGIIAISSFIGSLIASGVT------
ref|YP_256381.1|        LWVPISYAWTAESFPTRARSTGFALCDGIGHVGGGIGLIIIASFISSLLSSGVTTG----
ref|YP_001191851.1|     LWIPISYAWTTENFPTRARVTGFGLADGIGHIGGGIGAFLVALQIGNIVSHGVTSNTPLE
ref|NP_376612.1|        VWVPVAYTWTAESFPTRARTSGFALCDGFGHLGGGLGVVYITSVATTLHSTVELFG-LIA
ref|YP_001234214.1|     VWVPIAYAWSVENYPTRARTTGFALVDGIGHLGGGVGMIAIAPLIPRLGVM--------A
RAAC03004               VWVPVFYAWTAENFPSRARTSGFALVDGAGHIGAGVGLWAIAPLIPSLGVT--------A
                        :*:*   *:*:.*.:*:***  :**.* ** **:*.*:*   ::        :

ref|NP_343451.1|        --------------------------------
ref|YP_256381.1|        --------------------------------
ref|YP_001191851.1|     VFMLMISFQLLSALISLAGIRTAKRRLDEISP
ref|NP_376612.1|        GFLVVA-----AIIAMVTGHYTLGKRLDEISP
ref|YP_001234214.1|     AFLLIGGFLALAALVAQFGISTRARRLDDISP
RAAC03004               GFVAMSGFLLIAAFIALGGIASRGKVLEEISP
```

THERMOPHILIC AND THERMOACIDOPHILIC SUGAR TRANSPORTER GENES AND ENZYMES FROM ALICYCLOBACILLUS ACIDOCALDARIUS AND RELATED ORGANISMS, METHODS

RELATED APPLICATIONS

This application claims the benefit of the filing date of U.S. Provisional Patent Application Ser. No. 61/031,593, filed Feb. 26, 2008, for "THERMOPHILIC AND THERMOACIDOPHILIC SUGAR TRANSPORTER GENES AND ENZYMES FROM *ALICYCLOBACILLUS ACIDOCALDARIUS* AND RELATED ORGANISMS, METHODS."

GOVERNMENT RIGHTS

The United States Government has certain rights in this invention pursuant to Contract No. DE-AC07-99ID13727 and Contract No. DE-AC07-05ID14517 between the United States Department of Energy and Battelle Energy Alliance, LLC.

STATEMENT ACCORDING TO 37 C.F.R. §1.52(e)(5)—SEQUENCE LISTING SUBMITTED ON COMPACT DISC

Pursuant to 37 C.F.R. §1.52(e)(1)(ii), a compact disc containing an electronic version of the Sequence Listing has been submitted concomitant with this application, the contents of which are hereby incorporated by reference. A second compact disc is submitted and is an identical copy of the first compact disc. The discs are labeled "COPY 1 REPLACEMENT 06/12/2009" and "COPY 2 REPLACEMENT 06/12/2009," respectively, and each disc contains one file entitled "Replacement Utility Sequence List II.txt" which is 1,969 KB and created on Jun. 12, 2009.

TECHNICAL FIELD

The present invention relates generally to biotechnology. More specifically, the present invention relates to isolated and/or purified polypeptides and nucleic acid sequences encoding polypeptides from *Alicyclobacillus acidocaldarius* and methods for their use.

BACKGROUND

Dilute acid hydrolysis to remove hemicellulose from lignocellulosic materials is one of the most developed pretreatment techniques for lignocellulose and is currently favored (Hemelinck et al., 2005) because it results in fairly high yields of xylose (75-90%). Conditions that are typically used range from 0.1 to 1.5% sulfuric acid and temperatures above 160° C. The high temperatures used result in significant levels of thermal decomposition products that inhibit subsequent microbial fermentations (Lavarack et al., 2002). High temperature hydrolysis requires pressurized systems, steam generation, and corrosion resistant materials in reactor construction due to the more corrosive nature of acid at elevated temperatures.

Low temperature acid hydrolyses are of interest because they have the potential to overcome several of the above shortcomings (Tsao et al., 1987). It has been demonstrated that 90% of hemicellulose can be solubilized as oligomers in a few hours of acid treatment in the temperature range of 80-100° C. It has also been demonstrated that the sugars produced in low temperature acid hydrolysis are stable under those same conditions for at least 24 hours with no detectable degradation to furfural decomposition products. Finally, sulfuric acid typically used in pretreatments is not as corrosive at lower temperatures. The use of lower temperature acid pretreatments requires much longer reaction times to achieve acceptable levels of hydrolysis. Although 90% hemicellulose solubilization has been shown (Tsao, 1987), the bulk of the sugars are in the form of oligomers and are not in the monomeric form. The organisms currently favored in subsequent fermentation steps cannot utilize sugar oligomers (Garrote et al., 2001) and the oligomer-containing hydrolysates require further processing to monomers, usually as a second acid or alkaline hydrolysis step (Garrote et al., 2001).

Other acidic pretreatment methods include autohydrolysis and hot water washing. In autohydrolysis, biomass is treated with steam at high temperatures (~240° C.), which cleaves acetyl side chains associated with hemicellulose to produce acetic acid that functions in a similar manner to sulfuric acid in acid hydrolysis. Higher pretreatment temperatures are required as compared to dilute acid hydrolysis because acetic acid is a much weaker acid than sulfiric. At temperatures below 240° C., the hemicellulose is not completely hydrolyzed to sugar monomers and has high levels of oligomers (Garrote et al., 2001). In hot water washing, biomass is contacted with water (under pressure) at elevated temperatures 160-220° C. This process can effectively hydrolyze greater than 90% of the hemicellulose present and the solubilized hemicellulose was typically over 95% in the form of oligomers (Liu and Wyman, 2003).

BRIEF SUMMARY OF THE INVENTION

Embodiments of the invention relate to purified and/or isolated nucleotide sequences of the genome of *Alicyclobacillus acidocaldarius*, or a homologue or fragment thereof. In one embodiment of the invention, the nucleotide sequence is selected from at least one of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 or a homologue or fragment thereof. In another embodiment of the invention, the homologue is selected from the group consisting of a nucleotide sequence having at least 80% sequence identity to at least one of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767.

Embodiments of the invention may further relate to an isolated and/or purified nucleic acid sequence comprising a nucleic acid sequence encoding a polypeptide selected from the group consisting of a polypeptide having at least 90% sequence identity to at least one of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766.

Embodiments of the invention also relate to isolated and/or purified polypeptides coded for by a nucleotide sequence comprising a nucleotide sequence of the genome of *Alicyclobacillus acidocaldarius*, or a homologue or fragment thereof. In one embodiment, the nucleotide sequence comprises a nucleotide sequence selected from the group consisting of a nucleotide sequence having at least 80% sequence identity to at least one of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767.

In another embodiment of the invention, the nucleotide sequence comprises a nucleotide sequence selected from at least one of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 or a homologue or fragment thereof. In still another embodiment, the polypeptide comprises an amino acid sequence of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766. In yet another embodiment, the polypeptide comprises an amino acid sequence selected from the group consisting of a polypeptide having at least 90% sequence identity to at least one of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766.

In embodiments of the invention, the polypeptides may be acidophilic and/or thermophilic. In further embodiments, the polypeptides may be glycosylated, pegylated, and/or otherwise post-translationally modified.

Embodiments of methods include providing a recombinant, purified, and/or isolated polypeptide selected from the group consisting of a polypeptide having at least 90% sequence identity to SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 in or associated with a cell membrane and transporting a sugar across the cell membrane using the a recombinant, purified, and/or isolated polypeptide in conjunction with other cellular components.

Further embodiments of methods include placing a cell producing or encoding a recombinant, purified, and/or isolated nucleotide sequence comprising a nucleotide sequence selected from the group consisting of a nucleotide sequences having at least 90% sequence identity to at least one of the sequences of SEQ ID NOs: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 and/or a recombinant, purified, and/or isolated polypeptide selected from the group consisting of a polypeptide having at least 90% sequence identity to at least one of the sequences of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 in a environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0.

These and other aspects of the invention will become apparent to the skilled artisan in view of the teachings contained herein.

BRIEF DESCRIPTION OF THE SEVERAL VIEWS OF THE DRAWINGS

FIG. 1 depicts a sequence alignment between SEQ ID NO: 1 (RAAC00572) and emb|CAB65652.1|, ref|NP_623417.1|, ref|YP_001662812.1|, ref|YP_001179257.1|, and ref|YP_699602.1| (SEQ ID Nos: 3-7) respectively, which all have the function assigned to SEQ ID NO: 1 in Table 1. Amino acids conserved among all sequences are indicated by a "*" and generally conserved amino acids are indicated by a ":".

FIGS. 2A and 2B depict a sequence alignment between SEQ ID NO: 18 (RAAC00573) and emb|CAB65651.1|, pdb|1URG|A, pdb|1URD|A, ref|YP_001662811.1|, and ref|NP_623418.1| (SEQ ID Nos: 20-24) respectively, which all have the function assigned to SEQ ID NO: 18 in Table 1. Amino acids conserved among all sequences are indicated by a "*" and generally conserved amino acids are indicated by a ":".

FIGS. 3A and 3B depict a sequence alignment between SEQ ID NO: 35 (RAAC00608) and ref|NP_391276.1|, ref|YP_001422694.1|, ref|NP_347967.1|, ref|ZP_01886765.1|, and ref|YP_804553.1| (SEQ ID Nos: 37-41) respectively, which all have the function assigned to SEQ ID NO: 35 in Table 1. Amino acids conserved among all sequences are indicated by a "*" and generally conserved amino acids are indicated by a ":".

FIGS. 4A and 4B depict a sequence alignment between SEQ ID NO: 52 (RAAC00626) and ref|YP_001108359.1|, ref|YP_001662045.1|, ref|YP_147976.1|, ref|YP_001126119.1|, and ref|YP_001409972.1| (SEQ ID Nos: 54-58) respectively, which all have the function assigned to SEQ ID NO: 52 in Table 1. Amino acids conserved among all sequences are indicated by a "*" and generally conserved amino acids are indicated by a ":".

FIG. 5 depicts a sequence alignment between SEQ ID NO: 69 (RAAC00627) and ref|YP_001108360.1|, ref|ZP_01730302.1|, ref|YP_001662044.1|, ref|YP_171303.1|, and ref|YP_922080.1| (SEQ ID Nos: 71-75) respectively, which all have the function assigned to SEQ ID NO: 69 in Table 1. Amino acids conserved among all sequences are indicated by a "*" and generally conserved amino acids are indicated by a ":".

FIG. 6 depicts a sequence alignment between SEQ ID NO: 86 (RAAC00628) and ref|YP_001108361.1|, ref|YP_001662043.1|, ref|YP_147974.1|, ref|YP_001126117.1|, and ref|NP_694394.1| (SEQ ID Nos: 88-92) respectively, which all have the function assigned to SEQ ID NO: 89 in Table 1. Amino acids conserved among all sequences are indicated by a "*" and generally conserved amino acids are indicated by a ":".

FIGS. 7A and 7B depict a sequence alignment between SEQ ID NO: 103 (RAAC00662) and ref|YP_644805.1|, ref|YP_589403.1|, ref|YP_822512.1|, ref|YP_825097.1|, and ref|YP_001108350.1| (SEQ ID Nos: 105-109) respectively, which all have the function assigned to SEQ ID NO: 103 in Table 1. Amino acids conserved among all sequences are indicated by a "*" and generally conserved amino acids are indicated by a ":".

FIG. 8 depicts a sequence alignment between SEQ ID NO: 120 (RAAC00732) and emb|CAE45698.1|, ref|ZP_02329051.1|, ref|YP_001181115.|, ref|NP_623554.1|, and ref|YP_001664561.1| (SEQ ID Nos: 122-126) respectively, which all have the function assigned to SEQ ID NO: 120 in Table 1. Amino acids conserved among all sequences are indicated by a "*" and generally conserved amino acids are indicated by a ":".

FIGS. 9A and 9B depict a sequence alignment between SEQ ID NO: 137 (RAAC00804) and ref|NP_623507.1|, ref|YP_001469682.1|, ref|YP_145275.1|, ref|YP_006204.1|, and ref|YP_001432292.1| (SEQ ID Nos: 139-143) respectively, which all have the function assigned to SEQ ID NO: 137 in Table 1. Amino acids conserved among all sequences are indicated by a "*" and generally conserved amino acids are indicated by a ":".

FIGS. 10A and 10B depict a sequence alignment between SEQ ID NO: 154 (RAAC00824) and ref|ZP_02128903.1|, ref|YP_001243927.1|, ref|YP_001390862.1|, ref|YP_001254028.1|, and ref|NP_228405.1| (SEQ ID Nos: 156-160) respectively, which all have the function assigned to SEQ ID NO: 154 in Table 1. Amino acids conserved among all sequences are indicated by a "*" and generally conserved amino acids are indicated by a ":".

FIGS. 11A and 11B depict a sequence alignment between SEQ ID NO: 171 (RAAC01073) and ref|YP_804553.1|, ref|NP_391276.1|, ref|YP_001422694.1|, ref|NP_347967.1|, and ref|NP_978526.1| (SEQ ID Nos: 173-177) respectively, which all have the function assigned to SEQ ID NO: 171 in Table 1. Amino acids conserved among all sequences are indicated by a "*" and generally conserved amino acids are indicated by a ":".

FIGS. 12A and 12B depict a sequence alignment between SEQ ID NO: 188 (RAAC01120) and ref|YP_001089934.1|, ref|ZP_01801573.1|, ref|ZP_01173000.1|, ref|YP_076008.1|, and gb|ABP57783.1| (SEQ ID Nos: 190-194) respectively, which all have the function assigned to SEQ ID NO: 188 in Table 1. Amino acids conserved among all sequences are indicated by a "*" and generally conserved amino acids are indicated by a ":".

FIG. 13 depicts a sequence alignment between SEQ ID NO: 205 (RAAC01122) and ref|YP_001527659.1|, ref|YP_321082.1|, ref|NP_484832.1|, ref|ZP_01631485.1|, and gb|AAD33665.1|AF135398_2 (SEQ ID Nos: 207-211) respectively, which all have the function assigned to SEQ ID NO: 205 in Table 1. Amino acids conserved among all sequences are indicated by a "*" and generally conserved amino acids are indicated by a ":".

FIG. 14 depicts a sequence alignment between SEQ ID NO: 222 (RAAC01168) and ref|ZP_02083881.1|, ref|ZP_02075264.1|, ref|ZP_01461962.1|, ref|YP_632791.1|, and ref|NP_348945.1| (SEQ ID Nos: 224-228) respectively, which all have the function assigned to SEQ ID NO: 222 in Table 1. Amino acids conserved among all sequences are indicated by a "*" and generally conserved amino acids are indicated by a ":".

FIG. 15 depicts a sequence alignment between SEQ ID NO: 239 (RAAC01169) and ref|ZP_02075265.1|, ref|ZP_02083878.1|, ref|ZP_02085002.1|, ref|ZP_01978997.1|, and ref|ZP_02045164.1| (SEQ ID Nos: 241-245) respectively, which all have the function assigned to SEQ ID NO: 239 in Table 1. Amino acids conserved among all sequences are indicated by a "*" and generally conserved amino acids are indicated by a ":".

FIG. 16 depicts a sequence alignment between SEQ ID NO: 256 (RAAC01276) and ref|YP_173899.1|, ref|NP_241985.1|, ref|ZP_01168682.1|, ref|ZP_02087132.1|, and ref|YP_173890.1| (SEQ ID Nos: 258-262) respectively, which all have the function assigned to SEQ ID NO: 256 in Table 1. Amino acids conserved among all sequences are indicated by a "*" and generally conserved amino acids are indicated by a ":".

FIG. 17 depicts a sequence alignment between SEQ ID NO: 273 (RAAC01277) and ref|YP_949009.1|, ref|YP_173889.1|, ref|YP_001361891.1|, ref|YP_832803.1|, and ref|ZP_01168681.1| (SEQ ID Nos: 275-279) respectively, which all have the function assigned to SEQ ID NO: 273 in Table 1. Amino acids conserved among all sequences are indicated by a "*" and generally conserved amino acids are indicated by a ":".

FIGS. 18A and 18B depict a sequence alignment between SEQ ID NO: 290 (RAAC01278) and ref|YP_289760.1|, ref|NP_241983.1|, ref|YP_173897.1|, ref|YP_173888.1|, and ref|NP_357484.2| (SEQ ID Nos: 292-296) respectively, which all have the function assigned to SEQ ID NO: 290 in Table 1. Amino acids conserved among all sequences are indicated by a "*" and generally conserved amino acids are indicated by a ":".

FIG. 19 depicts a sequence alignment between SEQ ID NO: 307 (RAAC01279) and ref|NP_693016.1|, ref|ZP_01924075.1|, ref|YP_174646.1|, ref|ZP_01854967.1|, and ref|ZP_01088898.1| (SEQ ID Nos: 309-313) respectively, which all have the function assigned to SEQ ID NO: 307 in Table 1. Amino acids conserved among all sequences are indicated by a "*" and generally conserved amino acids are indicated by a ":".

FIGS. 20A and 20B depict a sequence alignment between SEQ ID NO: 324 (RAAC01316) and ref|YP_001523023.1|, ref|ZP_01746012.1|, ref|YP_001479789.1|, ref|YP_001585330.1|, and ref|NP_845565.1| (SEQ ID Nos: 326-330) respectively, which all have the function assigned to SEQ ID NO: 324 in Table 1. Amino acids conserved among all sequences are indicated by a "*" and generally conserved amino acids are indicated by a ":".

FIG. 21 depicts a sequence alignment between SEQ ID NO: 341 (RAAC01502) and ref|YP_001113858.1|, ref|ZP_02171111.1|, ref|YP_001488480.1|, ref|YP_878667.1|, and ref|NP_693494.11 (SEQ ID Nos: 343-347) respectively, which all have the function assigned to SEQ ID NO: 341 in Table 1. Amino acids conserved among all sequences are indicated by a "*" and generally conserved amino acids are indicated by a ":".

FIG. 22 depicts a sequence alignment between SEQ ID NO: 358 (RAAC01599) and ref|YP_114375.1|, ref|YP_001568000.1|, ref|YP_001254026.1|, ref|YP_001390860.1|, and ref|YP_001275707.1| (SEQ ID Nos: 360-364) respectively, which all have the function assigned to SEQ ID NO: 358 in Table 1. Amino acids conserved among all sequences are indicated by a "*" and generally conserved amino acids are indicated by a ":".

FIGS. 23A and 23B depict a sequence alignment between SEQ ID NO: 375 (RAAC01600) and ref|YP_076008.1|, ref|YP_001624170.1|, ref|YP_001089934.1|, ref|ZP_01801573.1|, and ref|ZP_01850509.1| (SEQ ID Nos: 377-381) respectively, which all have the function assigned to SEQ ID NO: 375 in Table 1. Amino acids conserved among all sequences are indicated by a "*" and generally conserved amino acids are indicated by a ":".

FIG. 24 depicts a sequence alignment between SEQ ID NO: 392 (RAAC01625) and ref|YP_001527658.1|, ref|ZP_01189621.1|, ref|YP_001327980.1|, ref|NP_436764.1|, and ref|NP_463711.1| (SEQ ID Nos: 394-398) respectively, which all have the function assigned to SEQ ID NO: 392 in Table 1. Amino acids conserved among all sequences are indicated by a "*" and generally conserved amino acids are indicated by a ":".

FIGS. 25A and 25B depict a sequence alignment between SEQ ID NO: 409 (RAAC01626) and ref|YP_001624853.1|, ref|YP_832862.1|, ref|NP_733496.1|, ref|NP_961026.1|, and ref|YP_881303.1| (SEQ ID Nos: 411-415) respectively, which all have the function assigned to SEQ ID NO: 409 in Table 1. Amino acids conserved among all sequences are indicated by a "*" and generally conserved amino acids are indicated by a ":".

FIG. 26 depicts a sequence alignment between SEQ ID NO: 426 (RAAC01627) and ref|ZP_01115262.1|, ref|NP_815894.1|, ref|YP_173820.1|, ref|NP_624601.1|, and ref|NP_336858.1| (SEQ ID Nos: 428-432) respectively, which all have the function assigned to SEQ ID NO: 426 in Table 1. Amino acids conserved among all sequences are indicated by a "*" and generally conserved amino acids are indicated by a ":".

FIGS. 27A and 27B depict a sequence alignment between SEQ ID NO: 443 (RAAC01754) and ref|ZP_01172341.1|, ref|YP_001665505.1|, ref|YP_001663811.1|, ref|YP_001124945.1|, and ref|NP_622450.1| (SEQ ID Nos: 445-449) respectively, which all have the function assigned to SEQ ID NO: 443 in Table 1. Amino acids conserved among all sequences are indicated by a "*" and generally conserved amino acids are indicated by a ":".

FIGS. 28A and 28B depict a sequence alignment between SEQ ID NO: 460 (RAAC01756) and ref|YP_001665503.1|, ref|NP_622452.1|, ref|YP_001179269.1|, ref|YP_001124947.1|, and ref|NP_244557.1| (SEQ ID Nos: 462-466) respectively, which all have the function assigned to SEQ ID NO: 460 in Table 1. Amino acids conserved among all sequences are indicated by a "*" and generally conserved amino acids are indicated by a ":".

FIG. 29 depicts a sequence alignment between SEQ ID NO: 477 (RAAC01757) and ref|YP_001665502.1|, ref|YP_001663808.1|, ref|NP_622453.1|, ref|ZP_01172344.1|, and ref|YP_001179270.1| (SEQ ID Nos: 479-483) respectively, which all have the function assigned to SEQ ID NO: 477 in Table 1. Amino acids conserved among all sequences are indicated by a "*" and generally conserved amino acids are indicated by a ":".

FIG. 30 depicts a sequence alignment between SEQ ID NO: 494 (RAAC01758) and ref|NP_622454.1|, ref|YP_001665501.1|, ref|YP_001663807.1|, ref|YP_001179271.1|, and ref|YP_001124949.1| (SEQ ID Nos: 496-500) respectively, which all have the function assigned to SEQ ID NO: 494 in Table 1. Amino acids conserved among all sequences are indicated by a "*" and generally conserved amino acids are indicated by a ":".

FIGS. 31A and 31B depict a sequence alignment between SEQ ID NO: 511 (RAAC01989) and ref|YP_001614945.1|, ref|YP_001619074.1|, ref|YP_001618197.1|, ref|YP_001471644.1|, and ref|YP_001613999.1| (SEQ ID Nos: 513-517) respectively, which all have the function assigned to SEQ ID NO: 511 in Table 1. Amino acids conserved among all sequences are indicated by a "*" and generally conserved amino acids are indicated by a FIG. 32 depicts a sequence alignment between SEQ ID NO: 528 (RAAC01990) and ref|YP_829900.1|, ref|YP_947699.1|, ref|YP_001032750.1|, ref|YP_001614944.1|, and ref|YP_001545164.1| (SEQ ID Nos: 530-534) respectively, which all have the function assigned to SEQ ID NO: 528 in Table 1. Amino acids conserved among all sequences are indicated by a "*" and generally conserved amino acids are indicated by a ":".

FIG. 33 depicts a sequence alignment between SEQ ID NO: 545 (RAAC01991) and ref|YP_001032749.1|, ref|YP_001567539.1|, ref|YP_614737.1|, ref|YP_001471642.1|, and ref|YP_063070.1| (SEQ ID Nos: 547-551) respectively, which all have the function assigned to SEQ ID NO: 545 in Table 1. Amino acids conserved among all sequences are indicated by a "*" and generally conserved amino acids are indicated by a ":".

FIG. 34 depicts a sequence alignment between SEQ ID NO: 562 (RAAC01992) and ref|YP_001614942.1|, ref|YP_001545162.1|, ref|ZP_01473687.1|, ref|NP_798861.1|, and ref|ZP_01262242.1| (SEQ ID Nos: 564-568) respectively, which all have the function assigned to SEQ ID NO: 562 in Table 1. Amino acids conserved among all sequences are indicated by a "*" and generally conserved amino acids are indicated by a ":".

FIG. 35 depicts a sequence alignment between SEQ ID NO: 579 (RAAC02175) and ref|YP_644454.1|, ref|ZP_00133639.2|, ref|YP_001337166.1|, ref|YP_001591175.1|, and ref|YP_355005.1| (SEQ ID Nos: 581-585) respectively, which all have the function assigned to SEQ ID NO: 579 in Table 1. Amino acids conserved among all sequences are indicated by a "*" and generally conserved amino acids are indicated by a ":".

FIG. 36 depicts a sequence alignment between SEQ ID NO: 596 (RAAC02176) and ref|ZP_01440479.1|, gb|EDR95515.1|, ref|YP_037038.1|, ref|ZP_02260050.1|, and ref|YP_029022.1| (SEQ ID Nos: 598-602) respectively, which all have the function assigned to SEQ ID NO: 596 in Table 1. Amino acids conserved among all sequences are indicated by a "*" and generally conserved amino acids are indicated by a ":".

FIG. 37 depicts a sequence alignment between SEQ ID NO: 613 (RAAC02177) and ref|NP_832709.1|, ref|YP_001565594.1|, ref|ZP_00239479.1|, ref|YP_001178244.1|, and ref|YP_001337168.1| (SEQ ID Nos: 615-619) respectively, which all have the function assigned to SEQ ID NO: 613 in Table 1. Amino acids conserved among all sequences are indicated by a "*" and generally conserved amino acids are indicated by a ":".

FIGS. 38A and 38B depict a sequence alignment between SEQ ID NO: 630 (RAAC02613) and ref|YP_001546405.1|, ref|ZP_02171436.1|, ref|ZP_02295559.1|, ref|YP_765572.1|, and ref|NP_106947.1| (SEQ ID Nos: 632-636) respectively, which all have the function assigned to SEQ ID NO: 630 in Table 1. Amino acids conserved among all sequences are indicated by a "*" and generally conserved amino acids are indicated by a ":".

FIG. 39 depicts a sequence alignment between SEQ ID NO: 647 (RAAC02614) and gb|AAD33665.1|AF135398_2, dbj|BAA28360.1|, ref|ZP_02016963.1|, ref|YP_765571.1|, and ref|NP_357451.2| (SEQ ID Nos: 649-653) respectively, which all have the function assigned to SEQ ID NO: 647 in Table 1. Amino acids conserved among all sequences are indicated by a "*" and generally conserved amino acids are indicated by a ":".

FIG. 40 depicts a sequence alignment between SEQ ID NO: 664 (RAAC02615) and ref|ZP_02171438.1|, ref|ZP_02016964.1|, ref|ZP_01188237.1|, ref|YP_176793.1|, and ref|YP_001546403.1| (SEQ ID Nos: 666-670) respectively, which all have the function assigned to SEQ ID NO: 664 in Table 1. Amino acids conserved among all sequences are indicated by a "*" and generally conserved amino acids are indicated by a ":".

FIG. 41 depicts a sequence alignment between SEQ ID NO: 681 (RAAC02733) and ref|YP_001179080.1|, ref|NP_244315.1|, ref|YP_147766.1|, ref|YP_001125909.1|, and ref|YP_077677.1| (SEQ ID Nos: 683-687) respectively, which all have the function assigned to SEQ ID NO: 681 in Table 1. Amino acids conserved among all sequences are indicated by a "*" and generally conserved amino acids are indicated by a ":".

FIG. 42 depicts a sequence alignment between SEQ ID NO: 698 (RAAC02734) and ref|YP_001179079.1|, ref|YP_001036823.1|, ref|YP_001312352.1|, ref|NP_437024.1|, and ref|YP_471845.1| (SEQ ID Nos: 700-704) respectively, which all have the function assigned to SEQ ID NO: 968 in Table 1. Amino acids conserved among all sequences are indicated by a "*" and generally conserved amino acids are indicated by a ":".

FIG. 43 depicts a sequence alignment between SEQ ID NO: 715 (RAAC04053) and ref|YP_001235093.1|, ref|YP_001547100.1|, ref|ZP_01464237.1|, ref|YP_001509451.1|, and ref|YP_430861.1| (SEQ ID Nos: 717-721) respectively, which all have the function assigned to SEQ ID NO: 715 in Table 1. Amino acids conserved among all sequences are indicated by a "*" and generally conserved amino acids are indicated by a ":".

FIG. 44 depicts a sequence alignment between SEQ ID NO: 732 (RAAC04054) and ref|YP_001547099.1|, gb|AAK01295.1|AF332585_1, ref|YP_001235092.1|, ref|YP_289977.1|, and ref|NP_823422.1| (SEQ ID Nos: 734-738) respectively, which all have the function assigned to SEQ ID NO: 732 in Table 1. Amino acids conserved among all sequences are indicated by a "*" and generally conserved amino acids are indicated by a ":".

FIG. 45 depicts a sequence alignment between SEQ ID NO: 749 (RAAC04055) and ref|YP_001547098.1|, ref|ZP_01464218.1|, ref|YP_001509449.1|, ref|YP_001235091.1|, and ref|YP_289976.1| (SEQ ID Nos: 751-755) respectively, which all have the function assigned to SEQ ID NO: 749 in Table 1. Amino acids conserved among all sequences are indicated by a "*" and generally conserved amino acids are indicated by a ":".

FIGS. 46A and 46B depict a sequence alignment between SEQ ID NO: 766 (RAAC03004) and ref|YP_001234214.1|, ref|NP_343451.1|, ref|YP_256381.1|, ref|NP_376612.1|, and ref|YP_001191851.1| (SEQ ID Nos: 768-772) respectively, which all have the function assigned to SEQ ID NO: 766 in Table 1. Amino acids conserved among all sequences are indicated by a "*" and generally conserved amino acids are indicated by a ":".

DETAILED DESCRIPTION OF THE INVENTION

Lignocellulose is a highly heterogeneous 3-dimensional matrix comprised primarily of cellulose, hemicellulose, and lignin. Many fuels and chemicals can be made from these lignocellulosic materials. To utilize lignocellulosic biomass for production of fuels and chemicals via fermentative processes, it is necessary to convert the plant polysaccharides to sugar monomers, which are then fermented to products using a variety of microorganisms. Direct hydrolysis of lignocellulose by mineral acids to monomers is possible at high temperature and pressure, leading to yield losses due to thermal decomposition of the sugars. Utilizing existing commercially available enzymes, a first strategy to reduce these yield losses is to perform the pretreatment at reduced severity to produce soluble oligomers, followed by the use of use cellulases and hemicellulases to depolymerize the polysaccharides at moderate temperatures. In a second approach, the addition of acid stable thermotolerant hydrolytic enzymes including cellulases, xylanases and other hemicellulases to the biomass slurry during the pretreatment allows the use of further reduced temperatures and pressures during the pretreatment, as well as cheaper materials of construction, reducing both the capital and energy costs. An extension of this second approach is to combine the enzyme-assisted reduced severity pretreatment together with fermentation under the same conditions, which further reduces costs.

Regardless of which approach is used, sugars generated by the approach may be used by cells to create useful fuels and chemicals, such, by way of non-limiting example, ethanol. Thus, transporters that function in low pH and/or high temperatures are useful to transport the generated sugars from the extracellular medium into a cell for secondary processing into a material of interest.

Embodiments of the invention include genes and associated proteins related to the metabolism and sugar transport of the thermoacidophile Alicyclobacillus acidocaldarius. Coding sequences for genes related to these processes were determined from sequence information generated from sequencing the genome of Alicyclobacillus acidocaldarius. These genes and proteins may represent targets for metabolic engineering of Alicyclobacillus acidocaldarius or other organisms. Non-limiting examples of nucleotide sequences found within the genome of Alicyclobacillus acidocaldarius, and amino acids coded thereby, associated with sugar transport are listed in Table 1. Sugar transporters and associated molecules may be, without limitation, of the following classes: glucose, galactose, xylose, mannose, arabinose, maltose, lactose, ribose, uronic acids formed from these sugars, acetylated sugars from the aforementioned classes, soluble saccharides of these sugars including dimers, trimers, and larger oligomers of the sugars both singly and in combination, transporters and associated molecules, saccharide transporters and associated molecules; polysaccharide and/or oligosaccharide transporters and associated molecules; cyclodextrin, melibiose, cellobiose, galacturonate, oligogalactouronate, glucarate, polyol, chitooligosaccharide, transporters and associated molecules; polyABC-type sugar transport systems, permease components; Maltose-binding periplasmic proteins/domains; Cyclodextrin-binding proteins; Arabinose/Xylose/Galactose permeases; Sodium-glucose/galactose cotransporters; ABC-type sugar transport systems, ATPase components; Na+/melibiose symporters and related transporters; ABC-type sugar transport system, periplasmic components; Arabinose/Xylose/Galactose permeases; Sugar binding proteins/transporters; ABC-type polysaccharide/polyol phosphate export systems, permease components; ABC-type polysaccharide/polyol phosphate transport systems, ATPase components; ABC-type Oligogalacturonate transport system permease protein OgtB; ABC-type Oligogalacturonate transport system permease protein OgtA; ABC-type Oligogalacturonate-binding protein OgtD, periplasmic components; Glucarate/galactarate transporters; Ribose transport system permease protein rbsC; Ribose/xylose/arabinose/galactoside ABC-type transport systems, permease components; ABC-type sugar transport system/extracellular sugar binding proteins, periplasmic components; Cellobiose transporters or regulators; Sugar-binding proteins; Oligosaccharide binding proteins; ABC oligosaccharide transporters; ABC oligosaccharide permeases/transporters; ABC chitooligosaccharide transporters; Ribose/xylose/arabinose/galactoside ABC-type transport systems, permease components; Ribose/xylose/arabinose/galactoside ABC-type transport systems, permease components; ABC-type sugar transport system, periplasmic components; Lactose-binding proteins; Lactose transport system permease protein lacF; D-ribose-binding proteins; Ribose/xylose/arabinose/galactoside ABC-type transport systems, permease components; ABC-type xylose transport system, periplasmic components; D-xylose-binding proteins; D-xylose transport ATP-binding protein xylG; ABC-type xylose transport system, permease components; xylH; D-Xylose proton-symporters; and Sugar kinase activities; and others.

Embodiments of the invention relate in part to the gene sequences and/or protein sequences comprising genes and/or proteins of Alicyclobacillus acidocaldarius. Genes and proteins included are those that play a role in sugar transport. Intracellular enzyme activities may be thermophilic and/or acidophilic in nature and general examples of similar genes are described in the literature. Classes of genes, sequences, enzymes and factors include, but are not limited to, those listed in Table 1.

TABLE 1

*Alicyclobacillus acidocaldarius* genes and proteins related to sugar transport

| Reference | Protein Sequence | Gene Sequence | Function |
|---|---|---|---|
| RAAC00572 | SEQ ID NO: 1 | SEQ ID NO: 2 | ABC-type sugar transport systems, permease components |
| RAAC00573 | SEQ ID NO: 18 | SEQ ID NO: 19 | Maltose-binding periplasmic proteins/domains; Cyclodextrin-binding protein |
| RAAC00608 | SEQ ID NO: 35 | SEQ ID NO: 36 | Arabinose/Xylose/Galactose permease |
| RAAC00626 | SEQ ID NO: 52 | SEQ ID NO: 53 | ABC-type sugar transport system, periplasmic component |
| RAAC00627 | SEQ ID NO: 69 | SEQ ID NO: 70 | ABC-type sugar transport systems, permease components |
| RAAC00628 | SEQ ID NO: 86 | SEQ ID NO: 87 | ABC-type sugar transport system, permease component |
| RAAC00662 | SEQ ID NO: 103 | SEQ ID NO: 104 | Sodium-glucose/galactose cotransporter |
| RAAC00732 | SEQ ID NO: 120 | SEQ ID NO: 121 | ABC-type sugar transport systems, ATPase components |
| RAAC00804 | SEQ ID NO: 137 | SEQ ID NO: 138 | Na+/melibiose symporter and related transporters |
| RAAC00824 | SEQ ID NO: 154 | SEQ ID NO: 155 | ABC-type sugar transport system, periplasmic component |
| RAAC01073 | SEQ ID NO: 171 | SEQ ID NO: 172 | Arabinose/Xylose/Galactose permease |
| RAAC01120 | SEQ ID NO: 188 | SEQ ID NO: 189 | Sugar binding protein/transport |
| RAAC01122 | SEQ ID NO: 205 | SEQ ID NO: 206 | ABC-type sugar transport systems, permease components |
| RAAC01168 | SEQ ID NO: 222 | SEQ ID NO: 223 | ABC-type polysaccharide/polyol phosphate export systems, permease component |
| RAAC01169 | SEQ ID NO: 239 | SEQ ID NO: 240 | ABC-type polysaccharide/polyol phosphate transport system, ATPase component |
| RAAC01276 | SEQ ID NO: 256 | SEQ ID NO: 257 | ABC-type Oligogalacturonate transport system permease protein OgtB |
| RAAC01277 | SEQ ID NO: 273 | SEQ ID NO: 274 | ABC-type Oligogalacturonate transport system permease protein OgtA |
| RAAC01278 | SEQ ID NO: 290 | SEQ ID NO: 291 | ABC-type Oligogalacturonate-binding protein OgtD, periplasmic component |
| RAAC01279 | SEQ ID NO: 307 | SEQ ID NO: 308 | ABC-type sugar transport system, periplasmic component |
| RAAC01316 | SEQ ID NO: 324 | SEQ ID NO: 325 | Glucarate/galactarate transporter |
| RAAC01502 | SEQ ID NO: 341 | SEQ ID NO: 342 | Ribose transport system permease protein rbsC; Ribose/xylose/arabinose/galactoside ABC-type transport systems, permease components |
| RAAC01599 | SEQ ID NO: 358 | SEQ ID NO: 359 | ABC-type sugar transport systems, permease components |
| RAAC01600 | SEQ ID NO: 375 | SEQ ID NO: 376 | ABC-type sugar transport system, periplasmic component |
| RAAC01625 | SEQ ID NO: 392 | SEQ ID NO: 393 | ABC-type sugar transport system, permease component |
| RAAC01626 | SEQ ID NO: 409 | SEQ ID NO: 410 | ABC-type sugar transport system/extracellular sugar binding protein, periplasmic component |
| RAAC01627 | SEQ ID NO: 426 | SEQ ID NO: 427 | ABC-type sugar transport systems, permease components |
| RAAC01754 | SEQ ID NO: 443 | SEQ ID NO: 444 | Cellobiose transport or regluator |
| RAAC01756 | SEQ ID NO: 460 | SEQ ID NO: 461 | ABC-type sugar transport system, periplasmic component; Sugar-binding protein |
| RAAC01757 | SEQ ID NO: 477 | SEQ ID NO: 478 | ABC-type sugar transport systems, permease components |
| RAAC01758 | SEQ ID NO: 494 | SEQ ID NO: 495 | ABC-type sugar transport system, permease component |
| RAAC01989 | SEQ ID NO: 511 | SEQ ID NO: 512 | Oligosaccharide binding protein |
| RAAC01990 | SEQ ID NO: 528 | SEQ ID NO: 529 | ABC oligosaccharide transport |
| RAAC01991 | SEQ ID NO: 545 | SEQ ID NO: 546 | ABC oligosaccharide permease/transport |
| RAAC01992 | SEQ ID NO: 562 | SEQ ID NO: 563 | ABC chitooligosaccharide transport |
| RAAC02175 | SEQ ID NO: 579 | SEQ ID NO: 580 | ABC-type sugar transport system, periplasmic component |
| RAAC02176 | SEQ ID NO: 596 | SEQ ID NO: 597 | Ribose/xylose/arabinose/galactoside ABC-type transport systems, permease components |
| RAAC02177 | SEQ ID NO: 613 | SEQ ID NO: 614 | Ribose/xylose/arabinose/galactoside ABC-type transport systems, permease components |
| RAAC02613 | SEQ ID NO: 630 | SEQ ID NO: 631 | ABC-type sugar transport system, periplasmic component; Lactose-binding protein |
| RAAC02614 | SEQ ID NO: 647 | SEQ ID NO: 648 | ABC-type sugar transport systems, permease components; Lactose transport system permease protein lacF |
| RAAC02615 | SEQ ID NO: 664 | SEQ ID NO: 665 | ABC-type sugar transport system, permease component |
| RAAC02733 | SEQ ID NO: 681 | SEQ ID NO: 682 | ABC-type sugar transport system, periplasmic component; D-ribose-binding protein |
| RAAC02734 | SEQ ID NO: 698 | SEQ ID NO: 699 | Ribose/xylose/arabinose/galactoside ABC-type transport systems, permease components |
| RAAC04053 | SEQ ID NO: 715 | SEQ ID NO: 716 | ABC-type xylose transport system, periplasmic component; D-xylose-binding protein |
| RAAC04054 | SEQ ID NO: 732 | SEQ ID NO: 733 | D-xylose transport ATP-binding protein xylG |
| RAAC04055 | SEQ ID NO: 749 | SEQ ID NO: 750 | ABC-type xylose transport system, permease component; xylH |
| RAAC03004 | SEQ ID NO: 766 | SEQ ID NO: 767 | D-XYLOSE PROTON-SYMPORTER; Predicted sugar kinase |

The present invention relates to nucleotides sequences comprising isolated and/or purified nucleotide sequences of the genome of *Alicyclobacillus acidocaldarius* selected from the sequences of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767, and 2858 or one of their fragments.

The present invention likewise relates to isolated and/or purified nucleotide sequences, characterized in that they comprise at least one of: a) a nucleotide sequence of at least one of the sequences of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 or one of their fragments; b) a nucleotide sequence homologous to a nucleotide sequence such as defined in a); c) a nucleotide sequence complementary to a nucleotide sequence such as defined in a) or b), and a nucleotide sequence of their corresponding RNA; d) a nucleotide sequence capable of hybridizing under stringent conditions with a sequence such as defined in a), b) or c); e) a nucleotide sequence comprising a sequence such as defined in a), b), c) or d); and f) a nucleotide sequence modified by a nucleotide sequence such as defined in a), b), c), d) or e).

Nucleotide, polynucleotide, or nucleic acid sequence will be understood according to the present invention as meaning both a double-stranded or single-stranded DNA in the monomeric and dimeric (so-called in tandem) forms and the transcription products of the DNAs.

Aspects of the invention relate nucleotide sequences, which it has been possible to isolate, purify or partially purify, starting from separation methods such as, for example, ion-exchange chromatography, by exclusion based on molecular size, or by affinity, or alternatively fractionation techniques based on solubility in different solvents, or starting from methods of genetic engineering such as amplification, cloning, and subcloning, it being possible for the sequences of the invention to be carried by vectors.

Isolated and/or purified nucleotide sequence fragment according to the invention will be understood as designating any nucleotide fragment of the genome of *Alicyclobacillus acidocaldarius*, and may include, by way of non-limiting examples, length of at least 8, 12, 20 25, 50, 75, 100, 200, 300, 400, 500, 1000, or more, consecutive nucleotides of the sequence from which it originates.

Specific fragment of an isolated and/or purified nucleotide sequence according to the invention will be understood as designating any nucleotide fragment of the genome of *Alicyclobacillus acidocaldarius*, having, after alignment and comparison with the corresponding fragments of genomic sequences of *Alicyclobacillus acidocaldarius*, at least one nucleotide or base of different nature.

Homologous isolated and/or purified nucleotide sequence, in the sense of the present invention, is understood as meaning isolated and/or purified a nucleotide sequence having at least a percentage identity with the bases of a nucleotide sequence according to the invention of at least about 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7%, this percentage being purely statistical and it being possible to distribute the differences between the two nucleotide sequences at random and over the whole of their length.

Specific homologous nucleotide sequence in the sense of the present invention is understood as meaning a homologous nucleotide sequence having at least one nucleotide sequence of a specific fragment, such as defined above. The "specific" homologous sequences can comprise, for example, the sequences corresponding to the genomic sequence or to the sequences of its fragments representative of variants of the genome of *Alicyclobacillus acidocaldarius*. These specific homologous sequences can thus correspond to variations linked to mutations within strains of *Alicyclobacillus acidocaldarius*, and especially correspond to truncations, substitutions, deletions and/or additions of at least one nucleotide. The homologous sequences can likewise correspond to variations linked to the degeneracy of the genetic code.

The term "degree or percentage of sequence homology" refers to "degree or percentage of sequence identity between two sequences after optimal alignment" as defined in the present application.

Two amino-acids or nucleotidic sequences are said to be "identical" if the sequence of amino-acids or nucleotidic residues, in the two sequences is the same when aligned for maximum correspondence as described below. Sequence comparisons between two (or more) peptides or polynucleotides are typically performed by comparing sequences of two optimally aligned sequences over a segment or "comparison window" to identify and compare local regions of sequence similarity. Optimal alignment of sequences for comparison may be conducted by the local homology algorithm of Smith and Waterman, *Ad. App. Math* 2: 482 (1981), by the homology alignment algorithm of Neddleman and Wunsch, *J. Mol. Biol.* 48: 443 (1970), by the search for similarity method of Pearson and Lipman, *Proc. Natl. Acad. Sci.* (U.S.A.) 85: 2444 (1988), by computerized implementation of these algorithms (GAP, BESTFIT, FASTA, and TFASTA in the Wisconsin Genetics Software Package, Genetics Computer Group (GCG), 575 Science Dr., Madison, Wis.), or by visual inspection.

"Percentage of sequence identity" (or degree of identity) is determined by comparing two optimally aligned sequences over a comparison window, where the portion of the peptide or polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity.

The definition of "sequence identity," given above, is the definition that would be used by one of skill in the art. The definition by itself does not need the help of any algorithm, the algorithms being helpful only to achieve the optimal alignments of sequences, rather than the calculation of sequence identity.

From the definition given above, it follows that there is a well-defined and only one value for the sequence identity between two compared sequences which value corresponds to the value obtained for the best or optimal alignment.

In the BLAST N or BLAST P "BLAST 2 sequence" software, which is available from the web site worldwideweb.ncbi.nlm.nih.gov/gorf/bl2.html, and habitually used by the inventors and in general by the skilled person for comparing and determining the identity between. two sequences, gap cost that depends on the sequence length to be compared is directly selected by the software (i.e., 11.2 for substitution matrix BLOSUM-62 for length>85).

Complementary nucleotide sequence of a sequence of the invention is understood as meaning any DNA whose nucleotides are complementary to those of the sequence of the invention, and whose orientation is reversed (antisense sequence).

Hybridization under conditions of stringency with a nucleotide sequence according to the invention is understood as meaning hybridization under conditions of temperature and ionic strength chosen in such a way that they allow the maintenance of the hybridization between two fragments of complementary DNA.

By way of illustration, conditions of great stringency of the hybridization step with the aim of defining the nucleotide fragments described above are advantageously the following.

The hybridization is carried out at a preferential temperature of 65° C. in the presence of SSC buffer, 1×SSC corresponding to 0.15 M NaCl and 0.05 M Na citrate. The washing steps, for example, can be the following: 2×SSC, at ambient temperature followed by two washes with 2×SSC, 0.5% SDS at 65° C.; 2×0.5×SSC, 0.5% SDS; at 65° C. for 10 minutes each.

The conditions of intermediate stringency, using, for example, a temperature of 42° C. in the presence of a 2×SSC buffer, or of less stringency, for example a temperature of 37° C. in the presence of a 2×SSC buffer, respectively require a globally less significant complementarity for the hybridization between the two sequences.

The stringent hybridization conditions described above for a polynucleotide with a size of approximately 350 bases will be adapted by the person skilled in the art for oligonucleotides of greater or smaller size, according to the teaching of Sambrook et al., 1989.

Among the isolated and/or purified nucleotide sequences according to the invention, are those that can be used as a primer or probe in methods allowing the homologous sequences according to the invention to be obtained, these methods, such as the polymerase chain reaction (PCR), nucleic acid cloning, and sequencing, being well known to the person skilled in the art.

Among the isolated and/or purified nucleotide sequences according to the invention, those are again preferred that can be used as a primer or probe in methods allowing the presence of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767, one of their fragments, or one of their variants such as defined below to be diagnosed.

The nucleotide sequence fragments according to the invention can be obtained, for example, by specific amplification, such as PCR, or after digestion with appropriate restriction enzymes of nucleotide sequences according to the invention, these methods in particular being described in the work of Sambrook et al., 1989. Such representative fragments can likewise be obtained by chemical synthesis according to methods well known to persons of ordinary skill in the art.

Modified nucleotide sequence will be understood as meaning any nucleotide sequence obtained by mutagenesis according to techniques well known to the person skilled in the art, and containing modifications with respect to the normal sequences according to the invention, for example mutations in the regulatory and/or promoter sequences of polypeptide expression, especially leading to a modification of the rate of expression of the polypeptide or to a modulation of the replicative cycle.

Modified nucleotide sequence will likewise be understood as meaning any nucleotide sequence coding for a modified polypeptide such as defined below. The present invention relates to nucleotide sequence comprising isolated and/or purified nucleotide sequences of *Alicyclobacillus acidocaldarius*, characterized in that they are selected from the sequences SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 or one of their fragments.

Embodiments of the invention likewise relate to isolated and/or purified nucleotide sequences, characterized in that they comprise a nucleotide sequence selected from: a) at least one of a nucleotide sequence of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 or one of their fragments or one of their fragments; b) a nucleotide sequence of a specific fragment of a sequence such as defined in a); c) a homologous nucleotide sequence having at least 80% identity with a sequence such as defined in a) or b); d) a complementary nucleotide sequence or sequence of RNA corresponding to a sequence such as defined in a), b) or c); and e) a nucleotide sequence modified by a sequence such as defined in a), b), c) or d).

Among the isolated and/or purified nucleotide sequences according to the invention are the nucleotide sequences of SEQ ID Nos. 13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 455-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, and 778-782, or fragments thereof and any isolated and/or purified nucleotide sequences, which have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with the at least one of the sequences of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 or fragments thereof. The homologous sequences can comprise, for example, the sequences corresponding to the genomic sequences *Alicyclobacillus acidocaldarius*. In the same manner, these specific homologous sequences can correspond to variations linked to mutations within strains of *Alicyclobacillus acidocaldarius* and especially correspond to truncations, substitutions, deletions and/or additions of at least one nucleotide. As will be apparent to one of ordinary skill in the art, such homologues are easily created and identified using standard techniques and publicly available computer programs such as BLAST. As such, each homologue referenced above should be considered as set forth herein and fully described.

Embodiments of the invention comprise the isolated and/or purified polypeptides coded for by a nucleotide sequence according to the invention, or fragments thereof, whose sequence is represented by a fragment. Amino acid sequences corresponding to the isolated and/or purified polypeptides, which can be coded for according to one of the three possible reading frames of at least one of the sequences of SEQ ID Nos. 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767.

Embodiments of the invention likewise relate to the isolated and/or purified polypeptides, characterized in that they comprise a polypeptide selected from at least one of the amino acid sequences of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 77, 494, 511, 528, 545, 562, 579, 596, 613, 630, 647, 664, 681, 698, 715, 732, 749, and 766 or one of their fragments.

Among the isolated and/or purified polypeptides, according to embodiments of the invention, are the isolated and/or purified polypeptides of amino acid sequence SEQ ID Nos. 8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, and 773-777, or fragments thereof or any other isolated and/or purified polypeptides that have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with at least one of the sequences of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 or fragments thereof. As will be apparent to one of ordinary skill in the art, such homologues are easily created and identified using standard techniques and publicly available computer programs such as BLAST. As such, each homologue referenced above should be considered as set forth herein and fully described.

Embodiments of the invention also relate to the polypeptides, characterized in that they comprise a polypeptide selected from: a) a specific fragment of at least 5 amino acids of a polypeptide of an amino acid sequence according to the invention; b) a polypeptide homologous to a polypeptide such as defined in a); c) a specific biologically active fragment of a polypeptide such as defined in a) or b); and d) a polypeptide modified by a polypeptide such as defined in a), b) or c).

In the present description, the terms polypeptide, peptide and protein are interchangeable.

In embodiments of the invention, the isolated and/or purified polypeptides according to the invention may be glycosylated, pegylated, and/or otherwise post-translationally modified. In further embodiments, glycosylation, pegylation, and/or other post-translational modifications may occur in vivo or in vitro and/or may be performed using chemical techniques. In additional embodiments, any glycosylation, pegylation and/or other post-translational modifications may be N-linked or O-linked.

In embodiments of the invention, any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other posttranslational modification may be required for the isolated and/or purified polypeptides according to the invention to be enzymatically or functionally active at pH at or below 8, 7, 6, 5, 4, 3, 2, 1, and/or 0 or at a temperatures at or above about 25, 30, 35, 40, 45, 50, 55, 60, 65, 70, 75, 80, 85, 90, and/or 95 degrees Celsius.

Aspects of the invention relate to polypeptides that are isolated or obtained by purification from natural sources, or else obtained by genetic recombination, or alternatively by chemical synthesis and that they may thus contain unnatural amino acids, as will be described below.

A "polypeptide fragment" according to the embodiments of the invention is understood as designating a polypeptide containing at least 5 consecutive amino acids, preferably 10 consecutive amino acids or 15 consecutive amino acids.

In the present invention, a specific polypeptide fragment is understood as designating the consecutive polypeptide fragment coded for by a specific fragment nucleotide sequence according to the invention.

"Homologous polypeptide" will be understood as designating the polypeptides having, with respect to the natural polypeptide, certain modifications such as, in particular, a deletion, addition, or substitution of at least one amino acid, a truncation, a prolongation, a chimeric fusion, and/or a mutation. Among the homologous polypeptides, those are preferred whose amino acid sequence has at least 80% or 90%, homology with the sequences of amino acids of polypeptides according to the invention.

"Specific homologous polypeptide" will be understood as designating the homologous polypeptides such as defined above and having a specific fragment of polypeptide according to the invention.

In the case of a substitution, one or more consecutive or nonconsecutive amino acids are replaced by "equivalent" amino acids. The expression "equivalent" amino acid is directed here at designating any amino acid capable of being substituted by one of the amino acids of the base structure without, however, essentially modifying the biological activities of the corresponding peptides and such that they will be defined by the following. As will be apparent to one of ordinary skill in the art, such substitutions are easily created and identified using standard molecular biology techniques and publicly available computer programs such as BLAST. As such, each substitution referenced above should be considered as set forth herein and fully described. Examples of such substitutions in the amino acid sequences SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 may include those isolated and/or purified polypeptides of amino acid sequence SEQ ID Nos. 8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, and 773-777. These equivalent amino acids may be determined either by depending on their structural homology with the amino acids that they substitute, or on results of comparative tests of biological activity between the different polypeptides, which are capable of being carried out.

By way of non-limiting example, the possibilities of substitutions capable of being carried out without resulting in an extensive modification of the biological activity of the corresponding modified polypeptides will be mentioned, the replacement, for example, of leucine by valine or isoleucine, of aspartic acid by glutamic acid, of glutamine by asparagine, of arginine by lysine etc., the reverse substitutions naturally being envisageable under the same conditions.

In a further embodiment, substitutions are limited to substitutions in amino acids not conserved among other proteins that have similar identified enzymatic activity. For example, one of ordinary skill in the art may align proteins of the same function in similar organisms and determine which amino acids are generally conserved among proteins of that function. One example of a program that may be used to generate such alignments is wordlwideweb.charite.de/bioinf/strap/ in conjunction with the databases provided by the NCBI. Examples of such polypeptides may include, but are not limited to, those found in amino acid sequence SEQ ID Nos. 8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, and 773-777.

Thus, according to one embodiment of the invention, substitutions or mutation may be made at positions that are generally conserved among proteins of that function. In a further embodiment, nucleic acid sequences may be mutated or substituted such that the amino acid they code for is unchanged (degenerate substitutions and/mutations) and/or mutated or substituted such that any resulting amino acid substitutions or mutation are made at positions that are generally conserved among proteins of that function. Examples of such nucleic acid sequences may include, but are not limited to, those found in are the nucleotide sequences of SEQ ID Nos. 13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 455-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, 778-782 or fragments thereof.

The specific homologous polypeptides likewise correspond to polypeptides coded for by the specific homologous nucleotide sequences such as defined above and thus comprise in the present definition the polypeptides, which are mutated or correspond to variants, which can exist in *Alicyclobacillus acidocaldarius*, and which especially correspond to truncations, substitutions, deletions, and/or additions of at least one amino acid residue.

"Specific biologically active fragment of a polypeptide" according to an embodiment of the invention will be understood in particular as designating a specific polypeptide fragment, such as defined above, having at least one of the characteristics of polypeptides according to the invention. In certain embodiments the peptide is capable of behaving as at least one of the types of proteins outlined in Table 1.

The polypeptide fragments according to embodiments of the invention can correspond to isolated or purified fragments naturally present in *Alicyclobacillus acidocaldarius* or correspond to fragments that can be obtained by cleavage of the polypeptide by a proteolytic enzyme, such as trypsin or chymotrypsin or collagenase, or by a chemical reagent, such as cyanogen bromide (CNBr). Such polypeptide fragments can likewise just as easily be prepared by chemical synthesis, from hosts transformed by an expression vector according to the invention containing a nucleic acid allowing the expression of the fragments, placed under the control of appropriate regulation and/or expression elements.

"Modified polypeptide" of a polypeptide according to an embodiment of the invention is understood as designating a polypeptide obtained by genetic recombination or by chemical synthesis as will be described below, having at least one modification with respect to the normal sequence. These modifications may or may not be able to bear on amino acids at the origin of specificity, and/or of activity, or at the origin of the structural conformation, localization, and of the capacity of membrane insertion of the polypeptide according to the invention. It will thus be possible to create polypeptides of equivalent, increased, or decreased activity, and of equivalent, narrower, or wider specificity. Among the modified polypeptides, it is necessary to mention the polypeptides in which up to 5 or more amino acids can be modified, truncated at the N- or C-terminal end, or even deleted or added.

The methods allowing the modulations on eukaryotic or prokaryotic cells to be demonstrated are well known to the person of ordinary skill in the art. It is likewise well understood that it will be possible to use the nucleotide sequences coding for the modified polypeptides for the modulations, for example, through vectors according to the invention and described below.

The preceding modified polypeptides can be obtained by using combinatorial chemistry, in which it is possible to systematically vary parts of the polypeptide before testing them on models, cell cultures or microorganisms, for example, to select the compounds that are most active or have the properties sought.

Chemical synthesis likewise has the advantage of being able to use unnatural amino acids, or nonpeptide bonds.

Thus, in order to improve the duration of life of the polypeptides according to the invention, it may be of interest to use unnatural amino acids, for example in D form, or else amino acid analogs, especially sulfur-containing forms, for example.

Finally, it will be possible to integrate the structure of the polypeptides according to the invention, its specific or modified homologous forms, into chemical structures of polypeptide type or others. Thus, it may be of interest to provide at the N- and C-terminal ends molecules not recognized by proteases.

The nucleotide sequences coding for a polypeptide according to the invention are likewise part of the invention.

The invention likewise relates to nucleotide sequences utilizable as a primer or probe, characterized in that the sequences are selected from the nucleotide sequences according to the invention.

It is well understood that the present invention, in various embodiments, likewise relates to specific polypeptides of *Alicyclobacillus acidocaldarius*, coded for by nucleotide sequences, capable of being obtained by purification from natural polypeptides, by genetic recombination or by chemical synthesis by procedures well known to the person skilled in the art and such as described in particular below. In the same manner, the labeled or unlabeled mono or polyclonal antibodies directed against the specific polypeptides coded for by the nucleotide sequences are also encompassed by the invention.

Embodiments of the invention additionally relate to the use of a nucleotide sequence according to the invention as a primer or probe for the detection and/or the amplification of nucleic acid sequences.

The nucleotide sequences according to embodiments of the invention can thus be used to amplify nucleotide sequences, especially by the PCR technique (polymerase chain reaction) (Erlich, 1989; Innis et al., 1990; Rolfs et al., 1991; and White et al., 1997).

These oligodeoxyribonucleotide or oligoribonucleotide primers advantageously have a length of at least 8 nucleotides, preferably of at least 12 nucleotides, and even more preferentially at least 20 nucleotides.

Other amplification techniques of the target nucleic acid can be advantageously employed as alternatives to PCR.

The nucleotide sequences of the invention, in particular the primers according to the invention, can likewise be employed in other procedures of amplification of a target nucleic acid, such as: the TAS technique (Transcription-based Amplification System), described by Kwoh et al. in 1989; the 3SR technique (Self-Sustained Sequence Replication), described by Guatelli et al. in 1990; the NASBA technique (Nucleic Acid Sequence Based Amplification), described by Kievitis et al. in 1991; the SDA technique (Strand Displacement Amplification) (Walker et al., 1992); the TMA technique (Transcription Mediated Amplification).

The polynucleotides of the invention can also be employed in techniques of amplification or of modification of the nucleic acid serving as a probe, such as: the LCR technique (Ligase Chain Reaction), described by Landegren et al. in 1988 and improved by Barany et al. in 1991, which employs a thermostable ligase; the RCR technique (Repair Chain Reaction), described by Segev in 1992; the CPR technique (Cycling Probe Reaction), described by Duck et al. in 1990; the amplification technique with Q-beta replicase, described by Miele et al. in 1983 and especially improved by Chu et al. in 1986, Lizardi et al. in 1988, then by Burg et al. as well as by Stone et al. in 1996.

In the case where the target polynucleotide to be detected is possibly an RNA, for example an mRNA, it will be possible to use, prior to the employment of an amplification reaction with the aid of at least one primer according to the invention or to the employment of a detection procedure with the aid of at least one probe of the invention, an enzyme of reverse transcriptase type in order to obtain a cDNA from the RNA contained in the biological sample. The cDNA obtained will thus serve as a target for the primer(s) or the probe(s) employed in the amplification or detection procedure according to the invention.

The detection probe will be chosen in such a manner that it hybridizes with the target sequence or the amplicon generated from the target sequence. By way of sequence, such a probe will advantageously have a sequence of at least 12 nucleotides, in particular of at least 20 nucleotides, and preferably of at least 100 nucleotides.

Embodiments of the invention also comprise the nucleotide sequences utilizable as a probe or primer according to the invention, characterized in that they are labeled with a radioactive compound or with a nonradioactive compound.

The unlabeled nucleotide sequences can be used directly as probes or primers, although the sequences are generally labeled with a radioactive isotope ($^{32}P$, $^{35}S$, $^{3}H$, 125I) or with a nonradioactive molecule (biotin, acetylaminofluorene, digoxigenin, 5-bromodeoxyuridine, fluorescein) to obtain probes that are utilizable for numerous applications.

Examples of nonradioactive labeling of nucleotide sequences are described, for example, in French Patent No. 78.10975 or by Urdea et al. or by Sanchez-Pescador et al. in 1988.

In the latter case, it will also be possible to use one of the labeling methods described in patents FR-2 422 956 and FR-2 518 755.

The hybridization technique can be carried out in various manners (Matthews et al., 1988). The most general method consists in immobilizing the nucleic acid extract of cells on a support (such as nitrocellulose, nylon, polystyrene) and in incubating, under well-defined conditions, the immobilized target nucleic acid with the probe. After hybridization, the excess of probe is eliminated and the hybrid molecules formed are detected by the appropriate method (measurement of the radioactivity, of the fluorescence or of the enzymatic activity linked to the probe).

The invention, in various embodiments, likewise comprises the nucleotide sequences according to the invention, characterized in that they are immobilized on a support, covalently or noncovalently.

According to another advantageous mode of employing nucleotide sequences according to the invention, the latter can be used immobilized on a support and can thus serve to capture, by specific hybridization, the target nucleic acid obtained from the biological sample to be tested. If necessary, the solid support is separated from the sample and the hybridization complex formed between the capture probe, and the target nucleic acid is then detected with the aid of a second probe, a so-called detection probe, labeled with an easily detectable element.

Another aspect of the present invention is a vector for the cloning and/or expression of a sequence, characterized in that it contains a nucleotide sequence according to the invention.

The vectors according to the invention, characterized in that they contain the elements allowing the integration, expression and/or the secretion of the nucleotide sequences in a determined host cell, are likewise part of the invention.

The vector may then contain a promoter, signals of initiation and termination of translation, as well as appropriate regions of regulation of transcription. It may be able to be maintained stably in the host cell and can optionally have particular signals specifying the secretion of the translated protein. These different elements may be chosen as a function of the host cell used. To this end, the nucleotide sequences according to the invention may be inserted into autonomous replication vectors within the chosen host, or integrated vectors of the chosen host.

Such vectors will be prepared according to the methods currently used by the person skilled in the art, and it will be possible to introduce the clones resulting therefrom into an appropriate host by standard methods, such as, for example, lipofection, electroporation, and thermal shock.

The vectors according to the invention are, for example, vectors of plasmid or viral origin. One example of a vector for the expression of polypeptides of the invention is baculovirus.

These vectors are useful for transforming host cells in order to clone or to express the nucleotide sequences of the invention.

The invention likewise comprises the host cells transformed by a vector according to the invention.

These cells can be obtained by the introduction into host cells of a nucleotide sequence inserted into a vector such as defined above, then the culturing of the cells under conditions allowing the replication and/or expression of the transfected nucleotide sequence.

The host cell can be selected from prokaryotic or eukaryotic systems, such as, for example, bacterial cells (Olins and Lee, 1993), but likewise yeast cells (Buckholz, 1993), as well as plants cells, such as *Arabidopsis* sp., and animal cells, in particular the cultures of mammalian cells (Edwards and Aruffo, 1993), for example, Chinese hamster ovary (CHO) cells, but likewise the cells of insects in which it is possible to use procedures employing baculoviruses, for example sf9 insect cells (Luckow, 1993).

Embodiments of the invention likewise relate to organisms comprising one of the transformed cells according to the invention.

The obtainment of transgenic organisms according to the invention expressing one or more of the genes of *Alicyclobacillus acidocaldarius* or part of the genes may be carried out in, for example, rats, mice, or rabbits according to methods well known to the person skilled in the art, such as by viral or nonviral transfections. It will be possible to obtain the transgenic organisms expressing one or more of the genes by transfection of multiple copies of the genes under the control of a strong promoter of ubiquitous nature, or selective for one type of tissue. It will likewise be possible to obtain the transgenic organisms by homologous recombination in embryonic cell strains, transfer of these cell strains to embryos, selection of the affected chimeras at the level of the reproductive lines, and growth of the chimeras.

The transformed cells as well as the transgenic organisms according to the invention are utilizable in procedures for preparation of recombinant polypeptides.

It is today possible to produce recombinant polypeptides in relatively large quantity by genetic engineering using the cells transformed by expression vectors according to the invention or using transgenic organisms according to the invention.

The procedures for preparation of a polypeptide of the invention in recombinant form, characterized in that they employ a vector and/or a cell transformed by a vector according to the invention and/or a transgenic organism comprising one of the transformed cells according to the invention are themselves comprised in the present invention.

As used herein, "transformation" and "transformed" relate to the introduction of nucleic acids into a cell, whether prokaryotic or eukaryotic. Further, "transformation" and "transformed," as used herein, need not relate to growth control or growth deregulation.

Among the procedures for preparation of a polypeptide of the invention in recombinant form, the preparation procedures employing a vector, and/or a cell transformed by the vector and/or a transgenic organism comprising one of the transformed cells, containing a nucleotide sequence according to the invention coding for a polypeptide of *Alicyclobacillus acidocaldarius*.

A variant, according to the invention, may consist of producing a recombinant polypeptide fused to a "carrier" protein (chimeric protein). The advantage of this system is that it may allow stabilization of and/or a decrease in the proteolysis of the recombinant product, an increase in the solubility in the course of renaturation in vitro and/or a simplification of the purification when the fusion partner has an affinity for a specific ligand.

More particularly, the invention relates to a procedure for preparation of a polypeptide of the invention comprising the following steps: a) culture of transformed cells under conditions allowing the expression of a recombinant polypeptide of nucleotide sequence according to the invention; b) if need be, recovery of the recombinant polypeptide.

When the procedure for preparation of a polypeptide of the invention employs a transgenic organism according to the invention, the recombinant polypeptide is then extracted from the organism.

The invention also relates to a polypeptide that is capable of being obtained by a procedure of the invention such as described previously.

The invention also comprises a procedure for preparation of a synthetic polypeptide, characterized in that it uses a sequence of amino acids of polypeptides according to the invention.

The invention likewise relates to a synthetic polypeptide obtained by a procedure according to the invention.

The polypeptides according to the invention can likewise be prepared by techniques that are conventional in the field of the synthesis of peptides. This synthesis can be carried out in homogeneous solution or in solid phase.

For example, recourse can be made to the technique of synthesis in homogeneous solution described by Houben-Weyl in 1974.

This method of synthesis consists in successively condensing, two by two, the successive amino acids in the order required, or in condensing amino acids and fragments formed previously and already containing several amino acids in the appropriate order, or alternatively several fragments previously prepared in this way, it being understood that it will be necessary to protect beforehand all the reactive functions carried by these amino acids or fragments, with the exception of amine functions of one and carboxyls of the other or vice versa, which must normally be involved in the formation of peptide bonds, especially after activation of the carboxyl function, according to the methods well known in the synthesis of peptides.

Recourse may also be made to the technique described by Merrifield.

To make a peptide chain according to the Merrifield procedure, recourse is made to a very porous polymeric resin, on which is immobilized the first C-terminal amino acid of the chain. This amino acid is immobilized on a resin through its carboxyl group and its amine function is protected. The amino acids, which are going to form the peptide chain, are thus immobilized, one after the other, on the amino group, which is deprotected beforehand each time, of the portion of the peptide chain already formed, and which is attached to the resin. When the whole of the desired peptide chain has been formed, the protective groups of the different amino acids forming the peptide chain are eliminated and the peptide is detached from the resin with the aid of an acid.

The invention additionally relates to hybrid polypeptides having at least one polypeptide according to the invention, and a sequence of a polypeptide capable of inducing an immune response in man or animals.

Advantageously, the antigenic determinant is such that it is capable of inducing a humoral and/or cellular response.

It will be possible for such a determinant to comprise a polypeptide according to the invention in glycosylated, pegylated, and/or otherwise post-translationally modified form used with a view to obtaining immunogenic compositions capable of inducing the synthesis of antibodies directed against multiple epitopes.

These hybrid molecules can be formed, in part, of a polypeptide carrier molecule or of fragments thereof according to the invention, associated with a possibly immunogenic part, in particular an epitope of the diphtheria toxin, the tetanus toxin, a surface antigen of the hepatitis B virus (patent FR 79 21811), the VP1 antigen of the poliomyelitis virus or any other viral or bacterial toxin or antigen.

The procedures for synthesis of hybrid molecules encompass the methods used in genetic engineering for constructing hybrid nucleotide sequences coding for the polypeptide sequences sought. It will be possible, for example, to refer advantageously to the technique for obtainment of genes coding for fusion proteins described by Minton in 1984.

The hybrid nucleotide sequences coding for a hybrid polypeptide as well as the hybrid polypeptides according to the invention characterized in that they are recombinant polypeptides obtained by the expression of the hybrid nucleotide sequences are likewise part of the invention.

The invention likewise comprises the vectors characterized in that they contain one of the hybrid nucleotide sequences. The host cells transformed by the vectors, the transgenic organisms comprising one of the transformed cells as well as the procedures for preparation of recombinant polypeptides using the vectors, the transformed cells and/or the transgenic organisms are, of course, likewise part of the invention.

The polypeptides according to the invention, the antibodies according to the invention described below and the nucleotide sequences according to the invention can advantageously be employed in procedures for the detection and/or identification of *Alicyclobacillus acidocaldarius*, in a sample capable of containing them. These procedures, according to the specificity of the polypeptides, the antibodies and the nucleotide sequences according to the invention, which will be used, will in particular be able to detect and/or to identify *Alicyclobacillus acidocaldarius*.

The polypeptides according to the invention can advantageously be employed in a procedure for the detection and/or the identification of *Alicyclobacillus acidocaldarius* in a sample capable of containing them, characterized in that it comprises the following steps: a) contacting of this sample with a polypeptide or one of its fragments according to the invention (under conditions allowing an immunological reaction between the polypeptide and the antibodies possibly present in the biological sample); b) demonstration of the antigen-antibody complexes possibly formed.

Any conventional procedure can be employed for carrying out such a detection of the antigen-antibody complexes possibly formed.

By way of example, a preferred method brings into play immunoenzymatic processes according to the ELISA technique, by immunofluorescence, or radioimmunological processes (RIA) or their equivalent.

Thus, the invention likewise relates to the polypeptides according to the invention, labeled with the aid of an adequate label, such as, of the enzymatic, fluorescent or radioactive type.

Such methods comprise, for example, the following steps: deposition of determined quantities of a polypeptide composition according to the invention in the wells of a microtiter plate, introduction into the wells of increasing dilutions of serum, or of a biological sample other than that defined previously, having to be analyzed, incubation of the microtiter plate, introduction into the wells of the microtiter plate of labeled antibodies directed against pig immunoglobulins, the labeling of these antibodies having been carried out with the aid of an enzyme selected from those which are capable of hydrolyzing a substrate by modifying the absorption of the radiation of the latter, at least at a determined wavelength, for example at 550 nm, detection, by comparison with a control test, of the quantity of hydrolyzed substrate.

The polypeptides according to the invention allow monoclonal or polyclonal antibodies to be prepared, which are characterized in that they specifically recognize the polypeptides according to the invention. It will advantageously be possible to prepare the monoclonal antibodies from hybridomas according to the technique described by Kohler and Milstein in 1975. It will be possible to prepare the polyclonal antibodies, for example, by immunization of an animal, in particular a mouse, with a polypeptide or a DNA, according to the invention, associated with an adjuvant of the immune response, and then purification of the specific antibodies contained in the serum of the immunized animals on an affinity column on which the polypeptide, which has served as an antigen, has previously been immobilized. The polyclonal antibodies according to the invention can also be prepared by purification, on an affinity column on which a polypeptide according to the invention has previously been immobilized, of the antibodies contained in the serum of an animal immunologically challenged by *Alicyclobacillus acidocaldarius*, or a polypeptide or fragment according to the invention.

The invention likewise relates to mono or polyclonal antibodies or their fragments, or chimeric antibodies, characterized in that they are capable of specifically recognizing a polypeptide according to the invention.

It will likewise be possible for the antibodies of the invention to be labeled in the same manner as described previously for the nucleic probes of the invention, such as a labeling of enzymatic, fluorescent or radioactive type.

The invention is additionally directed at a procedure for the detection and/or identification of *Alicyclobacillus acidocaldarius* in a sample, characterized in that it comprises the following steps: a) contacting of the sample with a mono or polyclonal antibody according to the invention (under conditions allowing an immunological reaction between the antibodies and the polypeptides of *Alicyclobacillus acidocaldarius* possibly present in the biological sample); b) demonstration of the antigen-antibody complex possibly formed.

The present invention likewise relates to a procedure for the detection and/or the identification of *Alicyclobacillus acidocaldarius* in a sample, characterized in that it employs a nucleotide sequence according to the invention.

More particularly, the invention relates to a procedure for the detection and/or the identification of *Alicyclobacillus acidocaldarius* in a sample, characterized in that it contains the following steps: a) if need be, isolation of the DNA from the sample to be analyzed; b) specific amplification of the DNA of the sample with the aid of at least one primer, or a pair of primers, according to the invention; c) demonstration of the amplification products.

These can be detected, for example, by the technique of molecular hybridization utilizing a nucleic probe according to the invention. This probe will advantageously be labeled with a nonradioactive (cold probe) or radioactive isotope.

For the purposes of the present invention, ""DNA of the biological sample" or ""DNA contained in the biological sample" will be understood as meaning either the DNA present in the biological sample considered, or possibly the cDNA obtained after the action of an enzyme of reverse transcriptase type on the RNA present in the biological sample.

A further embodiment of the invention comprises a method, characterized in that it comprises the following steps: a) contacting of a nucleotide probe according to the invention with a biological sample, the DNA contained in the biological sample having, if need be, previously been made accessible to hybridization under conditions allowing the hybridization of the probe with the DNA of the sample; b) demonstration of the hybrid formed between the nucleotide probe and the DNA of the biological sample.

The present invention also relates to a procedure according to the invention, characterized in that it comprises the following steps: a) contacting of a nucleotide probe immobilized on a support according to the invention with a biological sample, the DNA of the sample having, if need be, previously been made accessible to hybridization, under conditions allowing the hybridization of the probe with the DNA of the sample; b) contacting of the hybrid formed between the nucleotide probe immobilized on a support and the DNA contained in the biological sample, if need be after elimination of the DNA of the biological sample, which has not hybridized with the probe, with a nucleotide probe labeled according to the invention; c) demonstration of the novel hybrid formed in step b).

According to an advantageous embodiment of the procedure for detection and/or identification defined previously, this is characterized in that, prior to step a), the DNA of the biological sample is first amplified with the aid of at least one primer according to the invention.

Embodiments of methods include providing a recombinant, purified, and/or isolated polypeptide selected from the group consisting of a polypeptide having at least 90% sequence identity to SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 in or association with a cell membrane and transporting a sugar across the cell membrane using the a recombinant, purified, and/or isolated polypeptide in association with other cellular components.

Further embodiments of methods include placing a cell producing or encoding a recombinant, purified, and/or isolated nucleotide sequence comprising a nucleotide sequence selected from the group consisting of nucleotide sequences having at least 90% sequence identity to at least one of the sequences of SEQ ID NOs: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 and/or a recombinant, purified, and/or isolated polypeptide selected from the group consisting of a polypeptide having at least 90% sequence identity to at least one of the sequences of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 in a environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0.

The present invention provides cells that have been genetically manipulated to have an altered capacity to produce expressed proteins. In particular, the present invention relates to Gram-positive microorganisms, such as *Bacillus* species having enhanced expression of a protein of interest, wherein one or more chromosomal genes have been inactivated, and/or wherein one or more chromosomal genes have been deleted from the *Bacillus* chromosome. In some further embodiments, one or more indigenous chromosomal regions have been deleted from a corresponding wild-type *Bacillus* host chromosome. In further embodiments, the *Bacillus* is an *Alicyclobacillus* sp. or *Alicyclobacillus acidocaldarius*.

In additional embodiments, methods of transporting sugars at temperatures at or above about 25, 30, 35, 40, 45, 50, 55, 60, 65, 70, 75, 80, 85, 90, and/or 95 degrees Celsius and/or at a pH at, below, and/or above 8, 7, 6, 5, 4, 3, 2, 1, and/or 0 via a recombinant, purified, and/or isolated nucleotide sequence comprising a nucleotide sequence selected from the group consisting of nucleotide sequences having at least 90% sequence identity to at least one of the sequences of SEQ ID NOs: 2, 19, 36, 53, 70, 87, 104, 121, 138, 155, 172, 189, 206, 223, 240, 257, 274, 291, 308,325, 342, 359, 376, 393, 410, 427, 444, 461, 478, 495, 512, 529, 546, 563, 580, 597, 614, 631, 648, 665, 682, 699, 716, 733, 750, and 767 and/or a recombinant, purified, and/or isolated polypeptide selected from the group consisting of a polypeptide having at least 90% sequence identity to at least one of the sequences of SEQ ID Nos. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766.

In embodiments of the invention, any one of the isolated and/or purified polypeptides, according to the invention, may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other posttranslational modification may be required for the isolated and/or purified polypeptides according to the invention to be enzymatically or functionally active at a pH at or below 8, 7, 6, 5, 4, 3, 2, 1, and/or 0 or at a temperatures at or above about 25, 30, 35, 40, 45, 50, 55, 60, 65, 70, 75, 80, 85, 90, and/or 95 degrees Celsius.

The invention is described in additional detail in the following illustrative examples. Although the examples may represent only selected embodiments of the invention, it should be understood that the following examples are illustrative and not limiting.

EXAMPLES

Example 1

Sugar Transport Using Nucleotide and Amino Acid Sequences from *Alicyclobacillus acidocaldarius*

Provided in SEQ ID NO: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 are nucleotide sequences isolated from *Alicyclobacillus acidocaldarius* and coding for the polypeptides of SEQ ID NO: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766, respectively. The nucleotide sequences of SEQ ID NOs: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 are placed into expression vectors using techniques standard in the art. The vectors are then provided to cells such as bacteria cells or eukaryotic cells such as Sf9 cells or CHO cells. In conjunction with the normal machinery present in the cells, the vectors comprising SEQ ID NOs: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, and 767 produce the polypeptides of SEQ ID NOs: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766. The polypeptides of SEQ ID NOs: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 are then isolated and/or purified. The isolated and/or purified polypeptides of SEQ ID NOs: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 are then each demonstrated to have one or more of the activities provided in Table 1.

The isolated and/or purified polypeptides of SEQ ID NOs: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, and 766 are placed or transported into a cellular membrane and are demonstrated to have activity in transporting sugars across the membrane in conjunction with other proteins or cellular components.

All references, including publications, patents, and patent applications, cited herein are hereby incorporated by reference to the same extent, as if each reference were individually and specifically indicated to be incorporated by reference and were set forth in its entirety herein.

While this invention has been described in certain embodiments, the present invention can be further modified within the spirit and scope of this disclosure. This application is therefore intended to cover any variations, uses, or adapta-

BIBLIOGRAPHIC REFERENCES

Barany, F., 1911, PNAS. USA, 88: 189-193.
Buckholz, R. G., 1993, Yeast systems for the expression of heterologous gene products. Curr. Op. Biotechnology 4: 538-542.
Burg, J. L. et al., 1996, Mol. and Cell. Probes, 10: 257-271.
Chu, B. C. F. et al., 1986, NAR, 14: 5591-5603.
Duck, P. et al., 1990, Biotechniques, 9: 142-147.
Edwards, C. P., and Aruffo, A., 1993, Current applications of COS cell based transient expression systems. Curr. Op. Biotechnology 4: 558-563.
Guateli, J. C. et al., 1990, PNAS. USA, 87: 1874-1878.
Houben-Weyl, 1974, in Methode der Organischen Chemie, E. Wunsch Ed., Volume 15-I and 15-II, Thieme, Stuttgart.
Innis, M. A. et al., 1990, in PCR Protocols. A guide to Methods and Applications, San Diego, Academic Press.
Kievitis, T. et al., 1991, J. Virol. Methods, 35: 273-286.
Kohler, G. et al., 1975, Nature, 256(5517): 495497.
Kwoh, D. Y. et al., 1989, PNAS. USA, 86:1173-1177.
Luckow, V. A., 1993, Baculovirus systems for the expression of human gene products. Curr. Op. Biotechnology 4: 564-572.
Matthews, J. A. et al., 1988, Anal. Biochem., 169: 1-25.
Merrifield, R. D., 1966, J. Am. Chem. Soc., 88(21): 5051-5052.
Miele, E. A. et al., 1983, J. Mol. Biol., 171: 281-295.
Olins, P. O., and Lee, S. C., 1993, Recent advances in heterologous gene expression in *E. coli*. Curr. Op. Biotechnology 4: 520-525.
Rolfs, A. et al., 1991, In PCR Topics. Usage of Polymerase Chain reaction in Genetic and Infectious Disease. Berlin: Springer-Verlag.
Sambrook, J. et al., 1989, In Molecular cloning: A Laboratory Manual. Cold Spring Harbor, N.Y.: Cold Spring Harbor Laboratory Press.
Sanchez-Pescador, R., 1988, J. Clin. Microbiol., 26(10): 1934-1938.
Segev D., 1992, in "Non-radioactive Labeling and Detection of Biomolecules". Kessler C. Springer Verlag, Berlin, New-York: 197-205.
Urdea, M. S., 1988, Nucleic Acids Research, II: 4937-4957.
Walker, G. T. et al., 1992, NAR 20: 1691-1696.
Walker, G. T. et al., 1992, PNAS. USA, 89: 392-396.
White, B. A. et al., 1997, Methods in Molecular Biology, 67, Humana Press, Totowa, N.J.

SEQUENCE LISTING (782 sequences)

SEQ ID NO: 1 - protein, 321 aa, Alicyclobacillus acidocaldarius
MATVMEMRRSHGRERAKRRVDWVAYGYLSPALVTICVLSILPIFYTIYISFTNFNQMHFLSYQFVGLKNYEELLNPHDPLSNLFLPTFIWTLVYALCTTALAYLVGLFLAVLLNNKHMRERTLYRTLLIVPWAVPNLISMLAWQGLLNDQYGQINALLHGVFGLPRIPWLTSALWARIAVIMVNVWAGFPYMMTVCLGALQSIPTDQYEAAEIDGANWWQVFRYVTMPSVWRISLPLLIPSFSYNFNNFNASYLLTGGGPPNSNNPFLGQTDILATAAYKMTLTFNRYDLGATISVLLFILVALISWVQMRYTGAFKEVDA

SEQ ID NO: 2 - DNA, 966 bp, Alicyclobacillus acidocaldarius
atggccaccgtcatggagatgagaaggtctcacggccgggagcgcgcaaagcggcgcgtggattgggtcgcctacgggtacctctctccagcgctcgtcaccatctgtgttctcagcatcctacccattttttacactatatacatctcgtttactaattttaatcaaatgcactttctttcttatcagttcgtaggtttgaagaactatgaggaacttttaaatccgcatgatccgttgtcgaatctatttttgccgacattcatctggaccttggtgtacgcgctctgtaccacggcgctcgcgtatctcgtgggattgttcctcgccgtcctactcaataacaaacacatgcgggagcgcactctctatcgaacactgctcatcgtgccttgggcggttccgaacctcatttcaatgctcgcatggcagggcctgttgaacgatcagtacgggcaaatcaatgcacttttgcatggcgtgtttggcctgccgcgcattccctggctcacgagcgcgttatgggctcgaatcgctgtcatcatggtcaatgtttgggccggttttccctacatgatgaccgtttgtttaggtgctctgcagtcgatcccgaccgaccaatatgaggccgcggaaattgacggagccaactggtggcaagtgtttcggtatgtgaccatgccttcggtgtggcgaatctctttgccgctcctgataccgtctttttcatacaactttaacaacttcaacgcatcgtatctgttgactggaggcggaccgcccaattcgaacaacccattcctgggtcaaacggacattttggcaactgcggcctacaaaatgactcttacgttcaatcgctacgacttaggagcgacgatttccgttctgctgttcattcttgtggctcttatcagctgggtgcagatgcgctataccggagcctttaaggaggtcgatgcgtga

SEQ ID NO: 3 - protein, 321 aa, Alicyclobacillus acidocaldarius; identical to SEQ ID NO: 1

SEQ ID NO: 4 - protein, 293 aa, Thermoanaerobacter tengcongensis MB4
YAYLSPAILSMTVLSFAPMAYTIYIAFTNFNLYHFKNYQFVGFKNFVDILTGPFKNVFAPVFVWTVIYALSATLLSYIVGLLLAVILNNKHMWETNFYRAILIIPWGLPGTIAVLTWTGLLNQQYGGINLILQKLHLPMIPWLLEPFWAKVAIIMVSVWMGYPFMMNASLGALQAIPPELYEVADIDGASWFQKLTKITLPMLTSSTLPLIISSFAYNFNNFGTAFLITGGGPPRTDTSFAGHTDILVSAAYKLTMQANRYDLAAALSIIIFLIIGTLSLLNMRLTGAFKEVD

SEQ ID NO: 5 - protein, 293 aa, Thermoanaerobacter sp. X514
YAYLSPAILSMTVLSFAPILYTIYIAFTNFNLYHFKNYQFVGFKNFVDILAGPFKVVFAPVFVWTVIFALSATLLSYIIGLLLAVILNNKNMWETNLYRAILIIPWGLPGTIAALTWTGLLNQQYGGINLILQKLHLPMIPWLLDPFWARVAIIIVSVWMGYPFMMNASLGALQAIPPELYEVADIDGATWFQKFRMITVPMLTSSTLPLIISSFAYNFNNFGAAFLITGGGPPRTDTSFAGHTDLLVSSAYKMTMQFNRYDLAAALSIIIFLIIGTLSLINMKMTRAFEEVD

SEQ ID NO: 6 - protein, 292 aa, Caldicellulosiruptor saccharolyticus DSM 8903
IGYVYLAPALISMAVLSFFPIAMTVYYAFTNFNLNHMEDYKFVGFKNFVDIITGPFKEVFAPTFAWTFTFALITVLINFAVGLLLAVLLNNKFMKETNIYRSILIIPWAIPGTIASLAWQGLLNEEYGAINMLLKTFRLNPIPWMTDPFWAKISIFIVNLWLSYPFMMNASLGALQSIPPELYEVAEIDGAGWFTKLFKITIPMIVPTALPILISSFAYAFNNFNVVYLVTGGGPARLDTQFAGHTDLLVSTTYKLTMQFYRYDLASAMSIIIFFIVGTISLINMKLTRAFE

SEQ ID NO: 7 - protein, 307 aa, Clostridium perfringens SM101
KKQKRLKDTIKAMPYLLPALISIIIFTIIPIVYTVVIAFTDYTMYSQGHIKFVGFANFIEVLTGPFKEVFLPVFVWNIIFAVVSTAGTFFLGLIVAMAVNNPNIKEKSVYRAILIIPWALPATVAILSWQGLLNGSYGAINNLLLNLHLISNPIPWLTDPTWARVALIIVNIWLGFPYMMNVCLGALGAIPDSYYEAADVDGASKWLQFRKITLPSLAQISYPLLISSFAFNFNNFGSAFLITKGGPPRMSTQFAGYTDILASVNYKLSTQFGRFEIASAISIIIFLILGTISYYQMKLSGQFEEVE

SEQ ID NO: 8 - protein, 321 aa, Artificial
  Substituion in SEQ ID NO 1
MATIMEMRRSHGRERAKRRVDWVAYGYLSPALVTICVLSILPIFYTIYISFTNFNQMHFLSYQFVGLKNYEELLNPHDPLSNLFLPTFIWTLVYALCTTALAYLVGLFLAVLLNNKHMRERTLYRTLLIVPWAVPNLISMLAWQGLLNDQYGQINALLHGVFGLPRIPWLTSALWARIAVIMVNVWAGFPYMMTVCLGALQSIPTDQYEAAEIDGANWWQVFRYVTMPSVWRISLPLLIPSFSYNFNNFNASYLLTGGGPPNSNNPFLGQTDILATAAYKMTLTFNRYDLGATISVLLFILVALISWVQMRYTGAFKEVDA

SEQ ID NO: 9 - protein, 321 aa, Artificial
  Substituion in SEQ ID NO 1
MATVMEMRRSHGRERAKRRVDWVAYGYLSPALVTICVLSILPIFYTIYISFTNFNQMHFLSYQFVGLKNYEELLNPHDPLSNLFLPTFIWTLVYALCTTALAYLVGLFLAVLLNNKHMRERTLYRTLLIIPWAVPNLISMLAWQGLLNDQYGQINALLHGVFGLPRIPWLTSALWARIAVIMVNVWAGFPYMMTVCLGALQSIPTDQYEAAEIDGANWWQVFRYVTMPSVWRISLPLLIPSFSYNFNNFNASYLLTGGGPPNSNNPFLGQTDILATAAYKMTLTFNRYDLGATISVLLFILVALISWVQMRYTGAFKEVDA

SEQ ID NO: 10 - protein, 321 aa, Artificial
  Substituion in SEQ ID NO 1
MATVMEMRRSHGRERAKRRIDWVAYGYLSPALVTICVLSILPIFYTIYISFTNFNQMHFLSYQFVGLKNYEELLNPHDPLSNLFLPTFIWTLVYALCTTALAYLVGLFLAVLLNNKHMRERTLYRTLLIVPWAVPNLISMLAWQGLLNDQYGQINALLHGVFGLPRIPWLTSALWARIAVIMVNVWAGFPYMMTVCLGALQSIPTDQYEAAEIDGANWWQVFRYVTMPSVWRISLPLLIPSFSYNFNNFNASYLLTGGGPPNSNNPFLGQTDILATAAYKMTLTFNRYDLGATISVLLFILVALISWVQMRYTGAFKEVDA

SEQ ID NO: 11 - protein, 321 aa, Artificial
  Substituion in SEQ ID NO 1
MATVMEMRRSHGRERAKRRVDWVAYGYLSPALVTICVLSILPIFYTIYISFTNFNQMHFLSYQFVGLKNYEELLNPHDPLSNLFLPTFIWTLVYALCTTALAYLVGLFLAVLLNNKHMRERTLYRTLLIVPWAVPNLISMLAWQGLLNDQYGQINALLHGVFGLPKIPWLTSALWARIAVIMVNVWAGFPYMMTVCLGALQSIPTDQYEAAEIDGANWWQVFRYVTMPSVWRISLPLLIPSFSYNFNNFNASYLLTGGGPPNSNNPFLGQTDILATAAYKMTLTFNRYDLGATISVLLFILVALISWVQMRYTGAFKEVDA

SEQ ID NO: 12 - protein, 321 aa, Artificial
  Substituion in SEQ ID NO 1
MATVMEMRRSHGRERAKRRVDWVAYGYLSPALVTICVLSILPIFYTIYISFTNFNQMHFLSYQFVGLKNYEELLNPHDPLSNLFLPTFIWTLVYALCTTALAYLVGLFLAVLLNNKHMRERTLYRTLLIVPWAVPNIISMLAWQGLLNDQYGQINALLHGVFGLPRIPWLTSALWARIAVIMVNVWAGFPYMMTVCLGALQSIPTDQYEAAEIDGANWWQVFRYVTMPSVWRISLPLLIPSFSYNFNNFNASYLLTGGGPPNSNNPFLGQTDILATAAYKMTLTFNRYDLGATISVLLFILVALISWVQMRYTGAFKEVDA

SEQ ID NO: 13 - DNA, 966 bp, Artificial
  Substituion in SEQ ID NO 2
atggccaccattatggagatgagaaggtctcacggccgggagcgcgcaaagcggcgcgtggattgggtcgcctacgggtacctctctccagcgctcgtcaccatctgtgttctcagcatcctacccattttttacactatatacatctcgtttactaattttaatcaaatgcactttctttcttatcagttcgtaggtttgaagaactatgaggaacttttaaatccgcatgatccgttgtcgaatctatttttgccgacattcatctggaccttggtgtacgcgctctgtaccacggcgctcgcgtatctcgtgggattgttcctcgccgtcctactcaataacaaacacatgcgggagcgcactctctatcgaacactgctcatcgtgccttgggcggttccgaacctcatttcaatgctcgcatggcagggcctgttgaacgatcagtacgggcaaatcaatgcacttttgcatggcgtgtttggcctgccgcgcattccctggctcacgagcgcgttatgggctcgaatcgctgtcatcatggtcaatgtttgggccggttttccctacatgatgaccgtttgtttaggtgctctgcagtcgatcccgaccgaccaatatgaggccgcggaaattgacggagccaactggtggcaagtgtttcggtatgtgaccatgccttcggtgtggcgaatctctttgccgctcctgataccgtctttttcatacaactttaacaacttcaacgcatcgtatctgttgactggaggcggaccgcccaattcgaacaacccattcctgggtcaaacggacattttggcaactgcggcctacaaaatgactcttacgttcaatcgctacgacttaggagcgacgatttccgttctgctgttcattcttgtggctcttatcagctgggtgcagatgcgctataccggagcctttaaggaggtcgatgcgtga

SEQ ID NO: 14 - DNA, 966 bp, Artificial
  Substituion in SEQ ID NO 2
atggccaccgtcatggagatgagaaggtctcacggccgggagcgcgcaaagcggcgcgtggattgggtcgcctacgggtacctctctccagcgctcgtcaccatctgtgttctcagcatcctacccattttttacactatatacatctcgtttactaattttaatcaaatgcactttctttcttatcagttcgtaggtttgaagaactatgaggaacttttaaatccgcatgatccgttgtcgaatctatttttgccgacattcatctggaccttggtgtacgcgctctgtaccacggcgctcgcgtatctcgtgggattgttcctcgccgtcctactcaataacaaacacatgcgggagcgcactctctatcgaacactgctcatcattccttgggcggttccgaacctcatttcaatgctcgcatggcagggcctgttgaacgatcagtacgggcaaatcaatgcacttttgcatggcgtgtttggcctgccgcgcattccctggctcacgagcgcgttatgggctcgaatcgctgtcatcatggtcaatgtttgggccggttttccctacatgatgaccgtttgtttaggtgctctgcagtcgatcccgaccgaccaatatgaggccgcggaaattgacggagccaactggtggcaagtgtttcggtatgtgaccatgccttcggtgtggcgaatctctttgccgctcctgataccgtctttttcatacaactttaacaacttcaacgcatcgtatctgttgactggaggcggaccgcccaattcgaacaacccattcctgggtcaaacggacattttggcaactgcggcctacaaaatgactcttacgttcaatcgctacgacttaggagcgacgatttccgttctgctgttcattcttgtggctcttatcagctgggtgcagatgcgctataccggagcctttaaggaggtcgatgcgtga

SEQ ID NO: 15 - DNA, 966 bp, Artificial
  Substituion in SEQ ID NO 2
atggccaccgtcatggagatgagaaggtctcacggccgggagcgcgcaaagcggcgcattgattgggtcgcctacgggtacctctctccagcgctcgtcaccatctgtgttctcagcatcctacccattttttacactatatacatctcgtttactaattttaatcaaatgcactttctttcttatcagttcgtaggtttgaagaactatgaggaacttttaaatccgcatgatccgttgtcgaatctatttttgccgacattcatctggaccttggtgtacgcgctctgtaccacggcgctcgcgtatctcgtgggattgttcctcgccgtcctactcaataacaaacacatgcgggagcgcactctctatcgaacactgctcatcgtgccttgggcggttccgaacctcatttcaatgctcgcatggcagggcctgttgaacgatcagtacgggcaaatcaatgcacttttgcatggcgtgtttggcctgccgcgcattccctggctcacgagcgcgttatgggctcgaatcgctgtcatcatggtcaatgtttgggccggttttccctacatgatgaccgtttgtttaggtgctctgcagtcgatcccgaccgaccaatatgaggccgcggaaattgacggagccaactggtggcaagtgtttcggtatgtgaccatgccttcggtgtggcgaatctctttgccgctcctgataccgtctttttcatacaactttaacaacttcaacgcatcgtatctgttgactggaggcggaccgcccaattcgaacaacccattcctgggtcaaacggacattttggcaactgcggcctacaaaatgactcttacgttcaatcgctacgacttaggagcgacgatttccgttctgctgttcattcttgtggctcttatcagctgggtgcagatgcgctataccggagcctttaaggaggtcgatgcgtga

SEQ ID NO: 16 - DNA, 966 bp, Artificial
  Substituion in SEQ ID NO 2
atggccaccgtcatggagatgagaaggtctcacggccgggagcgcgcaaagcggcgcgtggattgggtcgcctacgggtacctctctccagcgctcgtcaccatctgtgttctcagcatcctacccattttttacactatatacatctcgtttactaattttaatcaaatgcactttctttcttatcagttcgtaggtttgaagaactatgaggaacttttaaatccgcatgatccgttgtcgaatctatttttgccgacattcatctggaccttggtgtacgcgctctgtaccacggcgctcgcgtatctcgtgggattgttcctcgccgtcctactcaataacaaacacatgcgggagcgcactctctatcgaacactgctcatcgtgccttgggcggttccgaacctcatttcaatgctcgcatggcagggcctgttgaacgatcagtacgggcaaatcaatgcacttttgcatggcgtgtttggcctgccgaaaattccctggctcacgagcgcgttatgggctcgaatcgctgtcatcatggtcaatgtttgggccggttttccctacatgatgaccgtttgtttaggtgctctgcagtcgatcccgaccgaccaatatgaggccgcggaaattgacggagccaactggtggcaagtgtttcggtatgtgaccatgccttcggtgtggcgaatctctttgccgctcctgataccgtctttttcatacaactttaacaacttcaacgcatcgtatctgttgactggaggcggaccgcccaattcgaacaacccattcctgggtcaaacggacattttggcaactgcggcctacaaaatgactcttacgttcaatcgctacgacttaggagcgacgatttccgttctgctgttcattcttgtggctcttatcagctgggtgcagatgcgctataccggagcctttaaggaggtcgatgcgtga

SEQ ID NO: 17 - DNA, 966 bp, Artificial
  Substituion in SEQ ID NO 2
atggccaccgtcatggagatgagaaggtctcacggccgggagcgcgcaaagcggcgcgtggattgggtcgcctacgggtacctctctccagcgctcgtcaccatctgtgttctcagcatcctacccattttttacactatatacatctcgtttactaattttaatcaaatgcactttctttcttatcagttcgtaggtttgaagaactatgaggaacttttaaatccgcatgatccgttgtcgaatctatttttgccgacattcatctggaccttggtgtacgcgctctgtaccacggcgctcgcgtatctcgtgggattgttcctcgccgtcctactcaataacaaacacatgcgggagcgcactctctatcgaacactgctcatcgtgccttgggcggttccgaacattatttcaatgctcgcatggcagggcctgttgaacgatcagtacgggcaaatcaatgcacttttgcatggcgtgtttggcctgccgcgcattccctggctcacgagcgcgttatgggctcgaatcgctgtcatcatggtcaatgtttgggccggttttccctacatgatgaccgtttgtttaggtgctctgcagtcgatcccgaccgaccaatatgaggccgcggaaattgacggagccaactggtggcaagtgtttcggtatgtgaccatgccttcggtgtggcgaatctctttgccgctcctgataccgtctttttcatacaactttaacaacttcaacgcatcgtatctgttgactggaggcggaccgcccaattcgaacaacccattcctgggtcaaacggacattttggcaactgcggcctacaaaatgactcttacgttcaatcgctacgacttaggagcgacgatttccgttctgctgttcattcttgtggctcttatcagctgggtgcagatgcgctataccggagcctttaaggaggtcgatgcgtga

SEQ ID NO: 18 - protein, 427 aa, Alicyclobacillus acidocaldarius
MSVRRWGIVSTGVAALVLAGGAIAGCGTSNGGQNTSPSTSSSSAKGEASALPKGQTITVWSWQTGPELQDVKQIAAQWAKAHGDKVIVVDQSSNPKGFQFYATAARTGKGPDVVFGMPHDNNGVFAEEGLMAPVPSGVLNTGLYAPNTIDAIKVNGTMYSVPVSVQVAAIYYNKKLVPQPPQTWAEFVKDANAHGFMYDQANLYFDYAIIGGYGGYVFKDNNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLRYAVPMPNIPQMQAVWQAMSILQNIIAGKVSPEQGAKDFVQNIQKGIMAQGS

SEQ ID NO: 19 - DNA, 1284 bp, Alicyclobacillus acidocaldarius
gtgtcggtgaggagatggggaatcgtatcgacaggtgtggccgcgctcgtgttggcgggcggagccatcgcgggctgtggaacctcgaacggtggtcaaaacacgtctccttccacgagctcgtcgagcgccaaaggggaggcaagcgctctgcccaaagggcagaccatcaccgtttggtcgtggcagacagggccggagttgcaagacgtgaagcagatcgccgctcagtgggcaaaggctcatggggacaaggtcattgtcgtcgaccaaagctccaatccgaagggattccagttctacgccacggcggctcgcacgggcaaggggcctgatgtcgtgtttggaatgccgcacgacaacaatggcgttttcgcagaagaaggattgatggcgccggtaccgtctggcgtgctcaacacgggtctctatgcacctaatacgatcgacgccatcaaggtcaacggcacgatgtactcggtgccagtatccgttcaggtcgcggcaatctactacaacaaaaagcttgtgccgcagccaccgcagacatgggccgaattcgtgaaagacgcaaatgcacatggcttcatgtatgaccaagcgaatctttacttcgattacgccattatcggcggctatggcgggtatgtgttcaaggacaacaacggcacactcgacccgaacaacataggtcttgacacaccgggggctgtgcaggcttacacgctgatgagggatatggtctccaagtatcactggatgaccccgagcacgaatggctctatcgcgaaggctgagtttctggctgggaagattggtatgtacgtgagtggcccatgggacacggcggatattgagaaggccaaaattgacttcggtgtaacgccatggcccaccttgccgaacggcaagcatgccacgcccttcttaggcgttatcacggcatttgtgaacaaggagtccaagacccaggcagctgactggagccttgttcaagcgttgaccagtgcgcaggcgcagcaaatgtacttcagagattcccagcagattcctgcgctcttgtctgtgcagaggtcgagcgccgtccagtcgagcccaacctttaaagcgttcgtcgaacagttgcgctacgcggtaccgatgcccaacattccgcaaatgcaggccgtgtggcaagcaatgagcatcctgcagaatatcattgcgggcaaggtgtcaccagagcagggtgcgaaggattttgtgcaaaacattcaaaaaggcatcatggcacaaggatcctga

SEQ ID NO: 20 - protein, 427 aa, Alicyclobacillus acidocaldarius; identical to SEQ ID NO: 18

SEQ ID NO: 21 - protein, 384 aa, Alicyclobacillus Acidocaldarius
AKGEASALPKGQTITVWSWQTGPELQDVKQIAAQWAKAHGDKVIVVDQSSNPKGFQFYATAARTGKGPDVVFGMPHDNNGVFAEEGLMAPVPSGVLNTGLYAPNTIDAIKVNGTMYSVPVSVQVAAIYYNKKLVPQPPQTWAEFVKDANAHGFMYDQANLYFDYAIIGGYGGYVFKDNNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLRYAVPMPNIPQMQAVWQAMSILQNIIAGKVSPEQGAKDFVQNIQKGIMAQGS

SEQ ID NO: 22 - protein, 370 aa, Alicyclobacillus Acidocaldarius
QTITVWSWQTGPELQDVKQIAAQWAKAHGDKVIVVDQSSNPKGFQFYATAARTGKGPDVVFGMPHDNNGVFAEEGLMAPVPSGVLNTGLYAPNTIDAIKVNGTMYSVPVSVQVAAIYYNKKLVPQPPQTWAEFVKDANAHGFMYDQANLYFDYAIIGGYGGYVFKDNNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLRYAVPMPNIPQMQAVWQAMSILQNIIAGKVSPEQGAKDFVQNIQKGIMA

SEQ ID NO: 23 - protein, 378 aa, Thermoanaerobacter sp. X514
SSGQTEQKKEPVELIVWSHLTDPEIAKVQEIANKWAEQTGNKVKVLADQSDFQAFSTAAQSGKGPDIMFGLPHDNLGTFQKAGLLAEVPDGVINKDDYVPMSISAVSYDGKMYAVPISMETYALFYNTDKVPTPPATLDDLIKLGKEVGFQYDVNNFYFSFAFISAYGGYVFKDTGGGLDPNDIGLNNDGAKKGLELIKDFVTKYKFMPADINGDMAKGNFQSGKTGLYISGPWDVDGFKKANVPFKVAPLPQVDGKPMPSFAGVQAAFVSANSKHQQEAWDLMKYLAENTGLPLFETGNRIPALKSLLDNPEVKNNEILNAFAEQATHAIPMPNIPQMAAVWTPAGNALQLITSGKVPVDKAADDMVNQIKQGIATQ

SEQ ID NO: 24 - protein, 362 aa, Thermoanaerobacter tengcongensis MB4
LIVWSHLTDPEIAKVQEIANKWAEQTGNKVKVLADQSDFQAFATAAQSGKGPDIMFGLPHDNLGTFQKAGLLAEVPEGVINKDDYVPMSISAVSYDGKMYAVPIAMETYALFYNTDKVKTPPATLDDLIKLGKEVGFQYDVNNFYFSFAFIAAYGGYVFKDTGGGLDPNDIGLNNEGAKKGLELIKDFVQKYKFMPPDINYDMAKGNFQSGKIGLYISGPWDVDGFKKANVPFKVAPLPKIDGKPTPSFAGVQAAFVSANSKHQKEAWDLMKYLVENTGLPLFETGNRIPVIKSLLDNPEVKGNEILSAFAEQAQHAIPMPNIPQMSQVWTPAGNALQLITSGKVPVDKAADDMVKQIKQGI

SEQ ID NO: 25 - protein, 427 aa, Artificial
  Substituion in SEQ ID NO 18
MSVRRWGIVSTGVAALVLAGGAIAGCGTSNGGQNTSPSTSSSSAKGEASALPKGQTITVWSWQTGPELQDVKQIAAQWAKAHGDKVIVVDQSSNPKGFQFYATAARTGKGPDVVFGMPHDNNGVFAEEGLMAPVPSGVLNTGLYAPNTIDAIKVNGTMYSVPVSVQVAAIYYNKKLVPQPPQTWAEFVKDANAHGFMYDQANLYFDYAIIGGYGGYVFKDNNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLKYAVPMPNIPQMQAVWQAMSILQNIIAGKVSPEQGAKDFVQNIQKGIMAQGS

SEQ ID NO: 26 - protein, 427 aa, Artificial
  Substituion in SEQ ID NO 18
MSVRRWGIVSTGVAALVLAGGAIAGCGTSNGGQNTSPSTSSSSAKGEASALPKGQTITVWSWQTGPELQDVKQIAAQWAKAHGDKVIVVDQSSNPKGFQFYATAARTGKGPDVVFGMPHDNNGVFADEGLMAPVPSGVLNTGLYAPNTIDAIKVNGTMYSVPVSVQVAAIYYNKKLVPQPPQTWAEFVKDANAHGFMYDQANLYFDYAIIGGYGGYVFKDNNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLRYAVPMPNIPQMQAVWQAMSILQNIIAGKVSPEQGAKDFVQNIQKGIMAQGS

SEQ ID NO: 27 - protein, 427 aa, Artificial
  Substituion in SEQ ID NO 18
MSVRRWGIVSTGVAALVLAGGAIAGCGTSNGGQNTSPSTSSSSAKGEASALPKGQTITVWSWQTGPELQDVKQIAAQWAKAHGDKVIVVDQSSNPKGFQFYATAARTGKGPDVVFGMPHDNNGVFAEEGLMAPVPSGVLNTGLYAPNTIDAIKVNGTMYSVPVSVQVAAIYYNKKLVPQPPQTWAEFVKDANAHGFMYDQANLYFEYAIIGGYGGYVFKDNNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLRYAVPMPNIPQMQAVWQAMSILQNIIAGKVSPEQGAKDFVQNIQKGIMAQGS

SEQ ID NO: 28 - protein, 427 aa, Artificial
  Substituion in SEQ ID NO 18
MSVRRWGIVSTGVAALVLAGGAIAGCGTSNGGQNTSPSTSSSSAKGEASALPKGQTITVWSWQTGPELQDVKQIAAQWAKAHGDKVIVVDQSSNPKGFQFYATAARTGKGPDVVFGMPHDNNGVFAEEGLMAPVPSGVLNTGLYAPNTIDAIKVNGTMYSVPVSVQVAAIYYNKKLVPQPPQTWAEFVKDANAHGFMYDQANLYFDYAIIGGYGGYVFKDQNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLRYAVPMPNIPQMQAVWQAMSILQNIIAGKVSPEQGAKDFVQNIQKGIMAQGS

SEQ ID NO: 29 - protein, 427 aa, Artificial
  Substituion in SEQ ID NO 18
MSVRRWGIISTGVAALVLAGGAIAGCGTSNGGQNTSPSTSSSSAKGEASALPKGQTITVWSWQTGPELQDVKQIAAQWAKAHGDKVIVVDQSSNPKGFQFYATAARTGKGPDVVFGMPHDNNGVFAEEGLMAPVPSGVLNTGLYAPNTIDAIKVNGTMYSVPVSVQVAAIYYNKKLVPQPPQTWAEFVKDANAHGFMYDQANLYFDYAIIGGYGGYVFKDNNGTLDPNNIGLDTPGAVQAYTLMRDMVSKYHWMTPSTNGSIAKAEFLAGKIGMYVSGPWDTADIEKAKIDFGVTPWPTLPNGKHATPFLGVITAFVNKESKTQAADWSLVQALTSAQAQQMYFRDSQQIPALLSVQRSSAVQSSPTFKAFVEQLRYAVPMPNIPQMQAVWQAMSILQNIIAGKVSPEQGAKDFVQNIQKGIMAQGS

SEQ ID NO: 30 - DNA, 1284 bp, Artificial
  Substituion in SEQ ID NO 19
gtgtcggtgaggagatggggaatcgtatcgacaggtgtggccgcgctcgtgttggcgggcggagccatcgcgggctgtggaacctcgaacggtggtcaaaacacgtctccttccacgagctcgtcgagcgccaaaggggaggcaagcgctctgcccaaagggcagaccatcaccgtttggtcgtggcagacagggccggagttgcaagacgtgaagcagatcgccgctcagtgggcaaaggctcatggggacaaggtcattgtcgtcgaccaaagctccaatccgaagggattccagttctacgccacggcggctcgcacgggcaaggggcctgatgtcgtgtttggaatgccgcacgacaacaatggcgttttcgcagaagaaggattgatggcgccggtaccgtctggcgtgctcaacacgggtctctatgcacctaatacgatcgacgccatcaaggtcaacggcacgatgtactcggtgccagtatccgttcaggtcgcggcaatctactacaacaaaaagcttgtgccgcagccaccgcagacatgggccgaattcgtgaaagacgcaaatgcacatggcttcatgtatgaccaagcgaatctttacttcgattacgccattatcggcggctatggcgggtatgtgttcaaggacaacaacggcacactcgacccgaacaacataggtcttgacacaccgggggctgtgcaggcttacacgctgatgagggatatggtctccaagtatcactggatgaccccgagcacgaatggctctatcgcgaaggctgagtttctggctgggaagattggtatgtacgtgagtggcccatgggacacggcggatattgagaaggccaaaattgacttcggtgtaacgccatggcccaccttgccgaacggcaagcatgccacgcccttcttaggcgttatcacggcatttgtgaacaaggagtccaagacccaggcagctgactggagccttgttcaagcgttgaccagtgcgcaggcgcagcaaatgtacttcagagattcccagcagattcctgcgctcttgtctgtgcagaggtcgagcgccgtccagtcgagcccaacctttaaagcgttcgtcgaacagttgaaatacgcggtaccgatgcccaacattccgcaaatgcaggccgtgtggcaagcaatgagcatcctgcagaatatcattgcgggcaaggtgtcaccagagcagggtgcgaaggattttgtgcaaaacattcaaaaaggcatcatggcacaaggatcctga

SEQ ID NO: 31 - DNA, 1284 bp, Artificial
  Substituion in SEQ ID NO 19
gtgtcggtgaggagatggggaatcgtatcgacaggtgtggccgcgctcgtgttggcgggcggagccatcgcgggctgtggaacctcgaacggtggtcaaaacacgtctccttccacgagctcgtcgagcgccaaaggggaggcaagcgctctgcccaaagggcagaccatcaccgtttggtcgtggcagacagggccggagttgcaagacgtgaagcagatcgccgctcagtgggcaaaggctcatggggacaaggtcattgtcgtcgaccaaagctccaatccgaagggattccagttctacgccacggcggctcgcacgggcaaggggcctgatgtcgtgtttggaatgccgcacgacaacaatggcgttttcgcagatgaaggattgatggcgccggtaccgtctggcgtgctcaacacgggtctctatgcacctaatacgatcgacgccatcaaggtcaacggcacgatgtactcggtgccagtatccgttcaggtcgcggcaatctactacaacaaaaagcttgtgccgcagccaccgcagacatgggccgaattcgtgaaagacgcaaatgcacatggcttcatgtatgaccaagcgaatctttacttcgattacgccattatcggcggctatggcgggtatgtgttcaaggacaacaacggcacactcgacccgaacaacataggtcttgacacaccgggggctgtgcaggcttacacgctgatgagggatatggtctccaagtatcactggatgaccccgagcacgaatggctctatcgcgaaggctgagtttctggctgggaagattggtatgtacgtgagtggcccatgggacacggcggatattgagaaggccaaaattgacttcggtgtaacgccatggcccaccttgccgaacggcaagcatgccacgcccttcttaggcgttatcacggcatttgtgaacaaggagtccaagacccaggcagctgactggagccttgttcaagcgttgaccagtgcgcaggcgcagcaaatgtacttcagagattcccagcagattcctgcgctcttgtctgtgcagaggtcgagcgccgtccagtcgagcccaacctttaaagcgttcgtcgaacagttgcgctacgcggtaccgatgcccaacattccgcaaatgcaggccgtgtggcaagcaatgagcatcctgcagaatatcattgcgggcaaggtgtcaccagagcagggtgcgaaggattttgtgcaaaacattcaaaaaggcatcatggcacaaggatcctga

SEQ ID NO: 32 - DNA, 1284 bp, Artificial
  Substituion in SEQ ID NO 19
gtgtcggtgaggagatggggaatcgtatcgacaggtgtggccgcgctcgtgttggcgggcggagccatcgcgggctgtggaacctcgaacggtggtcaaaacacgtctccttccacgagctcgtcgagcgccaaaggggaggcaagcgctctgcccaaagggcagaccatcaccgtttggtcgtggcagacagggccggagttgcaagacgtgaagcagatcgccgctcagtgggcaaaggctcatggggacaaggtcattgtcgtcgaccaaagctccaatccgaagggattccagttctacgccacggcggctcgcacgggcaaggggcctgatgtcgtgtttggaatgccgcacgacaacaatggcgttttcgcagaagaaggattgatggcgccggtaccgtctggcgtgctcaacacgggtctctatgcacctaatacgatcgacgccatcaaggtcaacggcacgatgtactcggtgccagtatccgttcaggtcgcggcaatctactacaacaaaaagcttgtgccgcagccaccgcagacatgggccgaattcgtgaaagacgcaaatgcacatggcttcatgtatgaccaagcgaatctttacttcgaatacgccattatcggcggctatggcgggtatgtgttcaaggacaacaacggcacactcgacccgaacaacataggtcttgacacaccgggggctgtgcaggcttacacgctgatgagggatatggtctccaagtatcactggatgaccccgagcacgaatggctctatcgcgaaggctgagtttctggctgggaagattggtatgtacgtgagtggcccatgggacacggcggatattgagaaggccaaaattgacttcggtgtaacgccatggcccaccttgccgaacggcaagcatgccacgcccttcttaggcgttatcacggcatttgtgaacaaggagtccaagacccaggcagctgactggagccttgttcaagcgttgaccagtgcgcaggcgcagcaaatgtacttcagagattcccagcagattcctgcgctcttgtctgtgcagaggtcgagcgccgtccagtcgagcccaacctttaaagcgttcgtcgaacagttgcgctacgcggtaccgatgcccaacattccgcaaatgcaggccgtgtggcaagcaatgagcatcctgcagaatatcattgcgggcaaggtgtcaccagagcagggtgcgaaggattttgtgcaaaacattcaaaaaggcatcatggcacaaggatcctga

SEQ ID NO: 33 - DNA, 1284 bp, Artificial
  Substituion in SEQ ID NO 19
gtgtcggtgaggagatggggaatcgtatcgacaggtgtggccgcgctcgtgttggcgggcggagccatcgcgggctgtggaacctcgaacggtggtcaaaacacgtctccttccacgagctcgtcgagcgccaaaggggaggcaagcgctctgcccaaagggcagaccatcaccgtttggtcgtggcagacagggccggagttgcaagacgtgaagcagatcgccgctcagtgggcaaaggctcatggggacaaggtcattgtcgtcgaccaaagctccaatccgaagggattccagttctacgccacggcggctcgcacgggcaaggggcctgatgtcgtgtttggaatgccgcacgacaacaatggcgttttcgcagaagaaggattgatggcgccggtaccgtctggcgtgctcaacacgggtctctatgcacctaatacgatcgacgccatcaaggtcaacggcacgatgtactcggtgccagtatccgttcaggtcgcggcaatctactacaacaaaaagcttgtgccgcagccaccgcagacatgggccgaattcgtgaaagacgcaaatgcacatggcttcatgtatgaccaagcgaatctttacttcgattacgccattatcggcggctatggcgggtatgtgttcaaggaccaaaacggcacactcgacccgaacaacataggtcttgacacaccgggggctgtgcaggcttacacgctgatgagggatatggtctccaagtatcactggatgaccccgagcacgaatggctctatcgcgaaggctgagtttctggctgggaagattggtatgtacgtgagtggcccatgggacacggcggatattgagaaggccaaaattgacttcggtgtaacgccatggcccaccttgccgaacggcaagcatgccacgcccttcttaggcgttatcacggcatttgtgaacaaggagtccaagacccaggcagctgactggagccttgttcaagcgttgaccagtgcgcaggcgcagcaaatgtacttcagagattcccagcagattcctgcgctcttgtctgtgcagaggtcgagcgccgtccagtcgagcccaacctttaaagcgttcgtcgaacagttgcgctacgcggtaccgatgcccaacattccgcaaatgcaggccgtgtggcaagcaatgagcatcctgcagaatatcattgcgggcaaggtgtcaccagagcagggtgcgaaggattttgtgcaaaacattcaaaaaggcatcatggcacaaggatcctga

SEQ ID NO: 34 - DNA, 1284 bp, Artificial
  Substituion in SEQ ID NO 19
gtgtcggtgaggagatggggaatcatttcgacaggtgtggccgcgctcgtgttggcgggcggagccatcgcgggctgtggaacctcgaacggtggtcaaaacacgtctccttccacgagctcgtcgagcgccaaaggggaggcaagcgctctgcccaaagggcagaccatcaccgtttggtcgtggcagacagggccggagttgcaagacgtgaagcagatcgccgctcagtgggcaaaggctcatggggacaaggtcattgtcgtcgaccaaagctccaatccgaagggattccagttctacgccacggcggctcgcacgggcaaggggcctgatgtcgtgtttggaatgccgcacgacaacaatggcgttttcgcagaagaaggattgatggcgccggtaccgtctggcgtgctcaacacgggtctctatgcacctaatacgatcgacgccatcaaggtcaacggcacgatgtactcggtgccagtatccgttcaggtcgcggcaatctactacaacaaaaagcttgtgccgcagccaccgcagacatgggccgaattcgtgaaagacgcaaatgcacatggcttcatgtatgaccaagcgaatctttacttcgattacgccattatcggcggctatggcgggtatgtgttcaaggacaacaacggcacactcgacccgaacaacataggtcttgacacaccgggggctgtgcaggcttacacgctgatgagggatatggtctccaagtatcactggatgaccccgagcacgaatggctctatcgcgaaggctgagtttctggctgggaagattggtatgtacgtgagtggcccatgggacacggcggatattgagaaggccaaaattgacttcggtgtaacgccatggcccaccttgccgaacggcaagcatgccacgcccttcttaggcgttatcacggcatttgtgaacaaggagtccaagacccaggcagctgactggagccttgttcaagcgttgaccagtgcgcaggcgcagcaaatgtacttcagagattcccagcagattcctgcgctcttgtctgtgcagaggtcgagcgccgtccagtcgagcccaacctttaaagcgttcgtcgaacagttgcgctacgcggtaccgatgcccaacattccgcaaatgcaggccgtgtggcaagcaatgagcatcctgcagaatatcattgcgggcaaggtgtcaccagagcagggtgcgaaggattttgtgcaaaacattcaaaaaggcatcatggcacaaggatcctga

SEQ ID NO: 35 - protein, 488 aa, Alicyclobacillus acidocaldarius
MADVVPTPWRRFAMSTQQTQGSRAYAVTISLAAAMGGLLYGYDTAVISGAIGFLKTLYHLSPFMQGLVISSIMIGGVIGVAVSGFLSDRVGRRKVLMTAAVLFAVAAFVSAISSDVTTLILARIVGGLGIGMGSALSVTYISECAPTQIRGALSSLYQLLTIIGIFLTYLTNYLIQRSGSVAWDVHTGWRWMLGLGCVPAAIFFFVLLFAPESPRWLAKVGRIDEALRILVRINGPSAGQRELESIRESIASESAASIRDLLKPGWRKALGVGILLALFNQIIGMNAVTYYGPEIFRMVGFSLNSDFEIQAFFGAMWVVFTVVAVVLIDRVGRKPLMIVGSALMAIFMALMGLTFYLHVHNGFWLVLFIMGFTAAFSVSMGPIPWIMIPEIFPNHLRARAAGVATIFLWGANWAIGQFTPVLLNDFGGAYTFWMFAVINILGVLFVTAWVPETKNRSLEEIESIWMASGRGVSLSQRDAHERAKRAHF

SEQ ID NO: 36 - DNA, 1467 bp, Alicyclobacillus acidocaldarius
atggccgacgtcgtgcccacaccttggaggaggttcgccatgtccactcagcagacacaaggctctcgcgcctacgcggtgaccatctcgctggcggcagcgatgggagggctgctctacggctacgataccgcggtcatttcgggagccatcggtttcttgaaaacgctctatcacctctcgcccttcatgcagggattggtcatctcgagcatcatgatcggcggcgtcatcggcgtggccgtctccggcttcttgagcgatcgcgtcggccgccgcaaggtcctcatgacggccgccgttctgttcgcggtggcggcgtttgtgtctgccatctcctccgatgtcaccacgctcattcttgcgcgaatcgtcggaggcctcggcatcggcatgggatcggcgctctcggtgacctacatctccgagtgtgcgccgacgcagatccgcggggcgctgtcgtcgctgtatcagctgctcaccatcatcggcatctttctcacctatctcaccaactacttgattcaacgctccggatcggtcgcctgggacgtgcacacgggttggcgctggatgctggggctgggctgcgtgccagcggctatcttctttttcgtccttctgtttgcacccgagagtccgcggtggttggcgaaggtcggccggatcgacgaggcgctgcggatcttggtgcgcatcaatgggccgagtgctggtcaacgtgaactcgagtccattcgcgaatcgattgcgagtgaaagcgctgcaagcatccgcgatcttctgaaacccggttggcgcaaggcgcttggtgtcgggattcttcttgcgctgttcaatcaaatcatcggcatgaacgccgtgacgtattacggccccgaaatcttcaggatggtggggttcagtctcaactccgatttcgagattcaagcgttcttcggcgccatgtgggtcgtgtttaccgttgtcgcggtcgtcctgatcgatcgcgtcggcagaaagcccctgatgatcgtcggctccgcgctgatggccatcttcatggcgctgatgggcttgaccttttacctgcacgttcacaacgggttctggctcgtgctcttcatcatgggcttcacggcggcgttcagcgtgtcgatgggtccgattccttggatcatgattccggaaatctttccgaatcacctgcgcgcccgcgcggccggcgtggcaaccatcttcctgtggggagccaactgggccatcggccagtttacgccagtattgctgaacgatttcggcggcgcctacaccttctggatgtttgcagtcatcaacatccttggggtgctgttcgtcacggcctgggtgccggagacgaaaaaccgttccctggaggagatcgaatccatctggatggcttcggggcgcggggtgtcgctgtcgcaacgagacgcgcacgaacgcgcgaagcgcgcccatttttga

SEQ ID NO: 37 - protein, 445 aa, Bacillus subtilis subsp. subtilis str. 168
SMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWI

SEQ ID NO: 38 - protein, 447 aa, Bacillus amyloliquefaciens FZB42
QHSKWFVILISCAAGLGGLLYGYDTAVISGAIGFLKDLYRLSPFMEGLVISSIMIGGVFGVGISGFLSDRFGRRKILMAAALLFAVSAVVSALSQSVSSLVIARVIGGLGIGMGSSLSVTYITEAAPPAIRGSLSSLYQLFTILGISGTYFINLAVQQSGSYEWGVHTGWRWMLAYGMIPSVIFFIVLLIVPESPRWLAKAGRRNEALAVLTRINGEQTAKEEIKQIETSLQLEKMGSLSQLFKPGLRKALVIGILLALFNQVIGMNAITYYGPEIFKMMGFGQNAGFITTCIVGVVEVIFTIIAVLLVDKVGRKKLMGVGSAFMALFMILIGASFYFQLASGPALVVIILGFVAAFCVSVGPITWIMISEIFPNHLRARAAGIATIFLWGANWAIGQFVPMMISGLGLAYTFWIFAVINILCFLFVVTICPETKNKSLEEIEKLWI

SEQ ID NO: 39 - protein, 449 aa, Clostridium acetobutylicum ATCC 824
SLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSK

SEQ ID NO: 40 - protein, 458 aa, Pedobacter sp. BAL39
QGSKSGTYLYLICLVAALGGFLFGFDTAVISGTVSLVKTDFDLNAVSEGWFVSCALLGCIIGVSFSGKLSDRYGRKIVLILSAVLFLASALGCMISSSFDVLIIFRLIGGLGIGVASMVSPLYISEFSPSRYRGMMVSLYQLALTIGIVLAYFSNAYLANHISDDYGTGSMQTIFSVEVWRGMLGLGAIPAAIFLISLFFVPESPRWLLLRGKDQKARQVLVKIDGAPAADREIAAFKAQDDNVEGSLKELFRPVFRKALYIGILLPFLSQICGINAVIYYGPRILEQAGFTLNNALGGQVTIGLVNVVFTFVAIFTIDKWGRKPLLFVGVGGAVISLIIIGVLFALGVTAGPWILIFILAFIACFAFSFGPVCWVVVGEIFPNAVRGKAMALATLSLWIGNFLVGQLTPVLLEGLGSSWTFFLFAICCSPALWITWKLIPETKGRSLEDIENYWKKS

SEQ ID NO: 41 - protein, 446 aa, Pediococcus pentosaceus ATCC 25745
YVILISCAAALGGLLFGYDTAVISGAVGFLQIKFTLSSAQVGWVTSCILIGCALGVSIAGILSDLFGRKKILALSAVIFALSSLGAAFAGSYMILVIWRMLAGIGIGLTSLITPLYIAEMAPSNVRGKLVSVNQLAITIGIFIVYFVNAAIASNATQLWNVSTGWRWMMGVGVIPSLLFLIALIPAGESPRWLSQHGKSEAAYKVLQKVEISDEAAEKSLEEIQMSEEVVDDTKFRDLFNKTWLPVLIIGVLLALFQQFSGSNAIMYYAPEIFKGAGFGQSGAFMATVSIGVINMVITIVALGLVDKIGRKKLLGWGSFAMSCCLLVVSICFFVHAATSITLTFVLLAIAAYAVSLAPVTWILISEIFPLKIRGRAMSICTAVLWLSDFTLSYTFPILTQNIGEGWTFMLYVVVTALSAIFVWKLVPETRGKSLEEIEVYWHAKSK

SEQ ID NO: 42 - protein, 488 aa, Artificial
  Substituion in SEQ ID NO 35
MADVVPTPWRRFAMSTQQTQGSRAYAVTISLAAAMGGLLYGYDTAVISGAIGFLKTLYHLSPFMQGLVISSIMIGGVIGVAVSGFLSDRVGRRKVLMTAAVLFAVAAFVSAISSDVTTLILARIVGGLGIGMGSALSVTYISECAPTQIRGALSSLYQLLTIIGIFLTYLTNYLIQRSGSVAWDVHTGWRWMLGLGCVPAAIFFFVLLFAPESPRWLAKVGRIDEALRILVRINGPSAGQRELESIRESIASESAASIRDLLKPGWRKALGVGILLALFNQIIGMNAVTYYGPEIFRMVGFSLNSDFEIQAFFGAMWVVFTVVAVVLIDRVGRKPLMIVGSALMAIFMALMGLTFYLHVHNGFWLVLFIMGFTAAFSVSMGPIPWIMIPEIFPQHLRARAAGVATIFLWGANWAIGQFTPVLLNDFGGAYTFWMFAVINILGVLFVTAWVPETKNRSLEEIESIWMASGRGVSLSQRDAHERAKRAHF

SEQ ID NO: 43 - protein, 488 aa, Artificial
  Substituion in SEQ ID NO 35
MADVVPTPWRRFAMSTQQTQGSRAYAVTISLAAAMGGLLYGYDTAVISGAIGFLKTLYHLSPFMQGLVISSIMIGGVIGVAVSGFLSDRVGRRKVLMTAAVLFAVAAFVSAISSDVTTLILARIVGGLGIGMGSALSVTYISECAPTQIRGALSSLYQLLTIIGIFLTYLTNYLIQRSGSVAWDVHTGWRWMLGLGCVPAAIFFFVLLFAPESPRWLAKVGRIDEALRILVRINGPSAGQRELESIRESIASESAASIRDLLKPGWRKALGVGLLLALFNQIIGMNAVTYYGPEIFRMVGFSLNSDFEIQAFFGAMWVVFTVVAVVLIDRVGRKPLMIVGSALMAIFMALMGLTFYLHVHNGFWLVLFIMGFTAAFSVSMGPIPWIMIPEIFPNHLRARAAGVATIFLWGANWAIGQFTPVLLNDFGGAYTFWMFAVINILGVLFVTAWVPETKNRSLEEIESIWMASGRGVSLSQRDAHERAKRAHF

SEQ ID NO: 44 - protein, 488 aa, Artificial
  Substituion in SEQ ID NO 35
MADVVPTPWRRFAMSTQQTQGSRAYAVTISLAAAMGGLLYGYDTAVISGAIGFLKTLYHLSPFMQGLVISSIMIGGVIGVAVSGFLSDRVGRRKVLMTAAVLFAVAAFVSAISSDVTTLILARIVGGLGIGMGSALSVTYISECAPTQIRGALSSLYQLLTIIGIFLTYLTNYLIQRSGSVAWDVHTGWRWMLGLGCVPAAIFFFVLLFAPESPRWLAKVGRIDEALRILVRINGPSAGQRELESIRESIASESAASIRDLLKPGWRKALGVGILLALFNQIIGMNAVTYYGPEIFRMVGFSLNSDFEIQAFFGAMWVVFTVVAVILIDRVGRKPLMIVGSALMAIFMALMGLTFYLHVHNGFWLVLFIMGFTAAFSVSMGPIPWIMIPEIFPNHLRARAAGVATIFLWGANWAIGQFTPVLLNDFGGAYTFWMFAVINILGVLFVTAWVPETKNRSLEEIESIWMASGRGVSLSQRDAHERAKRAHF

SEQ ID NO: 45 - protein, 488 aa, Artificial
  Substituion in SEQ ID NO 35
MADVVPTPWRRFAMSTQQTQGSRAYAVTISLAAAMGGLLYGYDTAVISGAIGFLKTLYHLSPFMQGLVISSIMIGGVIGVAVSGFLSDRVGRRKVLMTAAVLFAVAAFVSAISSDVTTLILARIVGGLGIGMGSALSVTYISECAPTQIRGALSSLYQLLTIIGIFLTYLTNYLIQRSGSVAWDVHTGWRWMLGLGCVPAAIFFFVLLFAPESPRWLAKVGRIDEALRILVRINGPSAGQRELESIRESIASESAASIRDLLKPGWRKALGVGILLALFNQIIGMNAVTYYGPEIFRMVGFSLNSDFEIQAFFGAMWVVFTVVAVVLIDRVGRKPLMIVGSALMAIFMALMGLTFYLHVHNGFWLVLFIMGFTAAFSVSMGPIPWIMIPEIFPNHLRARAAGVATIFLWGANWAIGQFTPVLLNDFGGAYTFWMFAVINILGVLFVTAWVPETKNRSLEEIESIWMASGRGVSISQRDAHERAKRAHF

SEQ ID NO: 46 - protein, 488 aa, Artificial
  Substituion in SEQ ID NO 35
MADVVPTPWRRFAMSTQQTQGSRAYAVTISLAAAMGGLLYGYDTAVISGAIGFLKTLYHLSPFMQGLVISSIMIGGVIGVAVSGFLSDRVGRRKVLMTAAVLFAVAAFVSAISSDVTTLILARIVGGLGIGMGSALSVTYISECAPTQIRGALSSLYQLLTLIGIFLTYLTNYLIQRSGSVAWDVHTGWRWMLGLGCVPAAIFFFVLLFAPESPRWLAKVGRIDEALRILVRINGPSAGQRELESIRESIASESAASIRDLLKPGWRKALGVGILLALFNQIIGMNAVTYYGPEIFRMVGFSLNSDFEIQAFFGAMWVVFTVVAVVLIDRVGRKPLMIVGSALMAIFMALMGLTFYLHVHNGFWLVLFIMGFTAAFSVSMGPIPWIMIPEIFPNHLRARAAGVATIFLWGANWAIGQFTPVLLNDFGGAYTFWMFAVINILGVLFVTAWVPETKNRSLEEIESIWMASGRGVSLSQRDAHERAKRAHF

SEQ ID NO: 47 - DNA, 1467 bp, Artificial
  Substituion in SEQ ID NO 36
atggccgacgtcgtgcccacaccttggaggaggttcgccatgtccactcagcagacacaaggctctcgcgcctacgcggtgaccatctcgctggcggcagcgatgggagggctgctctacggctacgataccgcggtcatttcgggagccatcggtttcttgaaaacgctctatcacctctcgcccttcatgcagggattggtcatctcgagcatcatgatcggcggcgtcatcggcgtggccgtctccggcttcttgagcgatcgcgtcggccgccgcaaggtcctcatgacggccgccgttctgttcgcggtggcggcgtttgtgtctgccatctcctccgatgtcaccacgctcattcttgcgcgaatcgtcggaggcctcggcatcggcatgggatcggcgctctcggtgacctacatctccgagtgtgcgccgacgcagatccgcggggcgctgtcgtcgctgtatcagctgctcaccatcatcggcatctttctcacctatctcaccaactacttgattcaacgctccggatcggtcgcctgggacgtgcacacgggttggcgctggatgctggggctgggctgcgtgccagcggctatcttctttttcgtccttctgtttgcacccgagagtccgcggtggttggcgaaggtcggccggatcgacgaggcgctgcggatcttggtgcgcatcaatgggccgagtgctggtcaacgtgaactcgagtccattcgcgaatcgattgcgagtgaaagcgctgcaagcatccgcgatcttctgaaacccggttggcgcaaggcgcttggtgtcgggattcttcttgcgctgttcaatcaaatcatcggcatgaacgccgtgacgtattacggccccgaaatcttcaggatggtggggttcagtctcaactccgatttcgagattcaagcgttcttcggcgccatgtgggtcgtgtttaccgttgtcgcggtcgtcctgatcgatcgcgtcggcagaaagcccctgatgatcgtcggctccgcgctgatggccatcttcatggcgctgatgggcttgaccttttacctgcacgttcacaacgggttctggctcgtgctcttcatcatgggcttcacggcggcgttcagcgtgtcgatgggtccgattccttggatcatgattccggaaatctttccgcaacacctgcgcgcccgcgcggccggcgtggcaaccatcttcctgtggggagccaactgggccatcggccagtttacgccagtattgctgaacgatttcggcggcgcctacaccttctggatgtttgcagtcatcaacatccttggggtgctgttcgtcacggcctgggtgccggagacgaaaaaccgttccctggaggagatcgaatccatctggatggcttcggggcgcggggtgtcgctgtcgcaacgagacgcgcacgaacgcgcgaagcgcgcccatttttga

SEQ ID NO: 48 - DNA, 1467 bp, Artificial
  Substituion in SEQ ID NO 36
atggccgacgtcgtgcccacaccttggaggaggttcgccatgtccactcagcagacacaaggctctcgcgcctacgcggtgaccatctcgctggcggcagcgatgggagggctgctctacggctacgataccgcggtcatttcgggagccatcggtttcttgaaaacgctctatcacctctcgcccttcatgcagggattggtcatctcgagcatcatgatcggcggcgtcatcggcgtggccgtctccggcttcttgagcgatcgcgtcggccgccgcaaggtcctcatgacggccgccgttctgttcgcggtggcggcgtttgtgtctgccatctcctccgatgtcaccacgctcattcttgcgcgaatcgtcggaggcctcggcatcggcatgggatcggcgctctcggtgacctacatctccgagtgtgcgccgacgcagatccgcggggcgctgtcgtcgctgtatcagctgctcaccatcatcggcatctttctcacctatctcaccaactacttgattcaacgctccggatcggtcgcctgggacgtgcacacgggttggcgctggatgctggggctgggctgcgtgccagcggctatcttctttttcgtccttctgtttgcacccgagagtccgcggtggttggcgaaggtcggccggatcgacgaggcgctgcggatcttggtgcgcatcaatgggccgagtgctggtcaacgtgaactcgagtccattcgcgaatcgattgcgagtgaaagcgctgcaagcatccgcgatcttctgaaacccggttggcgcaaggcgcttggtgtcgggttacttcttgcgctgttcaatcaaatcatcggcatgaacgccgtgacgtattacggccccgaaatcttcaggatggtggggttcagtctcaactccgatttcgagattcaagcgttcttcggcgccatgtgggtcgtgtttaccgttgtcgcggtcgtcctgatcgatcgcgtcggcagaaagcccctgatgatcgtcggctccgcgctgatggccatcttcatggcgctgatgggcttgaccttttacctgcacgttcacaacgggttctggctcgtgctcttcatcatgggcttcacggcggcgttcagcgtgtcgatgggtccgattccttggatcatgattccggaaatctttccgaatcacctgcgcgcccgcgcggccggcgtggcaaccatcttcctgtggggagccaactgggccatcggccagtttacgccagtattgctgaacgatttcggcggcgcctacaccttctggatgtttgcagtcatcaacatccttggggtgctgttcgtcacggcctgggtgccggagacgaaaaaccgttccctggaggagatcgaatccatctggatggcttcggggcgcggggtgtcgctgtcgcaacgagacgcgcacgaacgcgcgaagcgcgcccatttttga

SEQ ID NO: 49 - DNA, 1467 bp, Artificial
  Substituion in SEQ ID NO 36
atggccgacgtcgtgcccacaccttggaggaggttcgccatgtccactcagcagacacaaggctctcgcgcctacgcggtgaccatctcgctggcggcagcgatgggagggctgctctacggctacgataccgcggtcatttcgggagccatcggtttcttgaaaacgctctatcacctctcgcccttcatgcagggattggtcatctcgagcatcatgatcggcggcgtcatcggcgtggccgtctccggcttcttgagcgatcgcgtcggccgccgcaaggtcctcatgacggccgccgttctgttcgcggtggcggcgtttgtgtctgccatctcctccgatgtcaccacgctcattcttgcgcgaatcgtcggaggcctcggcatcggcatgggatcggcgctctcggtgacctacatctccgagtgtgcgccgacgcagatccgcggggcgctgtcgtcgctgtatcagctgctcaccatcatcggcatctttctcacctatctcaccaactacttgattcaacgctccggatcggtcgcctgggacgtgcacacgggttggcgctggatgctggggctgggctgcgtgccagcggctatcttctttttcgtccttctgtttgcacccgagagtccgcggtggttggcgaaggtcggccggatcgacgaggcgctgcggatcttggtgcgcatcaatgggccgagtgctggtcaacgtgaactcgagtccattcgcgaatcgattgcgagtgaaagcgctgcaagcatccgcgatcttctgaaacccggttggcgcaaggcgcttggtgtcgggattcttcttgcgctgttcaatcaaatcatcggcatgaacgccgtgacgtattacggccccgaaatcttcaggatggtggggttcagtctcaactccgatttcgagattcaagcgttcttcggcgccatgtgggtcgtgtttaccgttgtcgcggtcattctgatcgatcgcgtcggcagaaagcccctgatgatcgtcggctccgcgctgatggccatcttcatggcgctgatgggcttgaccttttacctgcacgttcacaacgggttctggctcgtgctcttcatcatgggcttcacggcggcgttcagcgtgtcgatgggtccgattccttggatcatgattccggaaatctttccgaatcacctgcgcgcccgcgcggccggcgtggcaaccatcttcctgtggggagccaactgggccatcggccagtttacgccagtattgctgaacgatttcggcggcgcctacaccttctggatgtttgcagtcatcaacatccttggggtgctgttcgtcacggcctgggtgccggagacgaaaaaccgttccctggaggagatcgaatccatctggatggcttcggggcgcggggtgtcgctgtcgcaacgagacgcgcacgaacgcgcgaagcgcgcccatttttga

SEQ ID NO: 50 - DNA, 1467 bp, Artificial
  Substituion in SEQ ID NO 36
atggccgacgtcgtgcccacaccttggaggaggttcgccatgtccactcagcagacacaaggctctcgcgcctacgcggtgaccatctcgctggcggcagcgatgggagggctgctctacggctacgataccgcggtcatttcgggagccatcggtttcttgaaaacgctctatcacctctcgcccttcatgcagggattggtcatctcgagcatcatgatcggcggcgtcatcggcgtggccgtctccggcttcttgagcgatcgcgtcggccgccgcaaggtcctcatgacggccgccgttctgttcgcggtggcggcgtttgtgtctgccatctcctccgatgtcaccacgctcattcttgcgcgaatcgtcggaggcctcggcatcggcatgggatcggcgctctcggtgacctacatctccgagtgtgcgccgacgcagatccgcggggcgctgtcgtcgctgtatcagctgctcaccatcatcggcatctttctcacctatctcaccaactacttgattcaacgctccggatcggtcgcctgggacgtgcacacgggttggcgctggatgctggggctgggctgcgtgccagcggctatcttctttttcgtccttctgtttgcacccgagagtccgcggtggttggcgaaggtcggccggatcgacgaggcgctgcggatcttggtgcgcatcaatgggccgagtgctggtcaacgtgaactcgagtccattcgcgaatcgattgcgagtgaaagcgctgcaagcatccgcgatcttctgaaacccggttggcgcaaggcgcttggtgtcgggattcttcttgcgctgttcaatcaaatcatcggcatgaacgccgtgacgtattacggccccgaaatcttcaggatggtggggttcagtctcaactccgatttcgagattcaagcgttcttcggcgccatgtgggtcgtgtttaccgttgtcgcggtcgtcctgatcgatcgcgtcggcagaaagcccctgatgatcgtcggctccgcgctgatggccatcttcatggcgctgatgggcttgaccttttacctgcacgttcacaacgggttctggctcgtgctcttcatcatgggcttcacggcggcgttcagcgtgtcgatgggtccgattccttggatcatgattccggaaatctttccgaatcacctgcgcgcccgcgcggccggcgtggcaaccatcttcctgtggggagccaactgggccatcggccagtttacgccagtattgctgaacgatttcggcggcgcctacaccttctggatgtttgcagtcatcaacatccttggggtgctgttcgtcacggcctgggtgccggagacgaaaaaccgttccctggaggagatcgaatccatctggatggcttcggggcgcggggtgtcgatttcgcaacgagacgcgcacgaacgcgcgaagcgcgcccatttttga

SEQ ID NO: 51 - DNA, 1467 bp, Artificial
  Substituion in SEQ ID NO 36
atggccgacgtcgtgcccacaccttggaggaggttcgccatgtccactcagcagacacaaggctctcgcgcctacgcggtgaccatctcgctggcggcagcgatgggagggctgctctacggctacgataccgcggtcatttcgggagccatcggtttcttgaaaacgctctatcacctctcgcccttcatgcagggattggtcatctcgagcatcatgatcggcggcgtcatcggcgtggccgtctccggcttcttgagcgatcgcgtcggccgccgcaaggtcctcatgacggccgccgttctgttcgcggtggcggcgtttgtgtctgccatctcctccgatgtcaccacgctcattcttgcgcgaatcgtcggaggcctcggcatcggcatgggatcggcgctctcggtgacctacatctccgagtgtgcgccgacgcagatccgcggggcgctgtcgtcgctgtatcagctgctcaccttaatcggcatctttctcacctatctcaccaactacttgattcaacgctccggatcggtcgcctgggacgtgcacacgggttggcgctggatgctggggctgggctgcgtgccagcggctatcttctttttcgtccttctgtttgcacccgagagtccgcggtggttggcgaaggtcggccggatcgacgaggcgctgcggatcttggtgcgcatcaatgggccgagtgctggtcaacgtgaactcgagtccattcgcgaatcgattgcgagtgaaagcgctgcaagcatccgcgatcttctgaaacccggttggcgcaaggcgcttggtgtcgggattcttcttgcgctgttcaatcaaatcatcggcatgaacgccgtgacgtattacggccccgaaatcttcaggatggtggggttcagtctcaactccgatttcgagattcaagcgttcttcggcgccatgtgggtcgtgtttaccgttgtcgcggtcgtcctgatcgatcgcgtcggcagaaagcccctgatgatcgtcggctccgcgctgatggccatcttcatggcgctgatgggcttgaccttttacctgcacgttcacaacgggttctggctcgtgctcttcatcatgggcttcacggcggcgttcagcgtgtcgatgggtccgattccttggatcatgattccggaaatctttccgaatcacctgcgcgcccgcgcggccggcgtggcaaccatcttcctgtggggagccaactgggccatcggccagtttacgccagtattgctgaacgatttcggcggcgcctacaccttctggatgtttgcagtcatcaacatccttggggtgctgttcgtcacggcctgggtgccggagacgaaaaaccgttccctggaggagatcgaatccatctggatggcttcggggcgcggggtgtcgctgtcgcaacgagacgcgcacgaacgcgcgaagcgcgcccatttttga

SEQ ID NO: 52 - protein, 468 aa, Alicyclobacillus acidocaldarius
MQMKSKVKRWTSVALASSAAAALVVGCGQPNNTASQTSTNGSASTAASSASTVSVAGVRIAKPTHLVNYKNASGTIVWAESFTTGPTASELVSAFEKKYPKIKVKLQVQPSNTDTNRADLTASISGGSSTPDVYMGDVIWPAQFAHNQLAAPLSDDLPTSFWTRFSNGLVAGATYNGKVYAAPLFADTAFLYYRKDLLAKYHLPVPKTWQQLQTEASYIVKHGGAKYGFVWQGADYEGLTCDFDEYLADAGGSVLTNGKATLNTAAAKQALSFMRGLITSGATPQSVDTFQEPQSENVFTQGNAVFLRNWSYAWSDSQNPQSSKVVGKVGVAPLPTFAGHGSSGYSTVGGWDLYLNPHTKNLAAALQFIDWMTSPQAQEILAANSEMPTIKAVADSPSLAKYSPVFALLPQVKFVSRPAQTPNYPAVSKAIYDNVNAALAGSVSVAQALKNANQQIQQALSGSGSGGL

SEQ ID NO: 53 - DNA, 1407 bp, Alicyclobacillus acidocaldarius
gtgcagatgaagagcaaggtcaagcgttggacaagcgtcgcgctcgcgagctcggcagccgcggcactggtcgttggatgcggccagccaaacaacacggcgtcccagaccagcacgaacggaagcgcatccactgcggcgtcgtccgccagcacggtgagcgtggccggggtgcggatcgcgaagccgacccaccttgtgaactacaagaacgcctcgggaacgattgtctgggcggaatcgtttaccactggccccaccgccagcgagttggtctcggcgtttgaaaagaaataccccaagatcaaagtgaagttgcaggttcagccctcgaacaccgacaccaaccgcgccgacctgacggcgtccatcagcggcggatcttccacgccggacgtctacatgggcgacgtgatctggcctgctcagtttgcccacaatcagttggcggcgcctctctcggatgatctgcccacgtccttctggacgcgcttttcgaacggcttggtggcaggagccacgtataacggaaaggtctacgcggcgccgctgtttgccgatacagcattcctttattaccgcaaggacctgttggccaagtatcatctgcccgtgccgaagacgtggcagcaactgcaaacggaggcttcttacatcgtcaagcacggtggagcgaagtatgggttcgtctggcagggcgctgattacgaggggctcacctgcgacttcgacgagtacctggcggatgcaggcggcagcgtgctgacgaacggcaaagctacactgaacacagcggctgcgaaacaggcactctcgttcatgcgagggctcatcacgtccggtgccacgccccaatcggtggacacgttccaggagccccagtctgagaatgtgttcacgcaagggaatgccgtgttcctgcgcaactggtcctacgcgtggtcggattcccagaatccgcaaagttcgaaggtcgtgggcaaggtcggcgtagcgcctcttccgacatttgctggacacggctcgagcggctacagcacggtcggtggctgggacctgtacctcaacccgcacacgaagaatctggcagccgcccttcagttcattgactggatgacgagcccgcaggctcaggaaattctggcggccaactcggagatgcccaccatcaaggctgtggcggacagcccgtcgctcgccaagtacagcccggtgttcgccctgttgccacaggtgaagttcgtctcgcggccggcgcagacaccgaactatccggcggtctccaaggccatttacgacaacgtcaacgcggcgctggctggcagtgtgtctgtagcgcaggcgctgaagaacgcgaaccagcaaattcagcaggctctgagcggcagcggttcgggcggtctctga

SEQ ID NO: 54 - protein, 374 aa, Saccharopolyspora erythraea NRRL 2338
LVDAFRAAHPNITVRIAQAPPTTDVQRATLTTQIASGAPRPDVYLGDCVWPAQFAHNSLATPLDTLVEPGFWDDFAEPVVTSLTYEDRRWAFPLYLSESFLYYRADLLAKHGIAVPRTWEELTRAARALTATGDVRYGLSWQAAPSETLTCNVAEFVADAGGELVAPDYSRATLDSAAGRRALGFVEELVGTGVSPRSVATFSEQESLTTFTGGQAAFLRNWAYAWGTAQDPSDSQVSGRIGATFRPTFDGATRSRVSTVGGWHNFVNPHTEQLGAAVAFARWMSGVDAQLILGMRSTQLPASLTAVNDPRIRQNDNPVLRMVPEVDLAPRPTRTPYYPQVSEAVYSNINPVVAGSSDPGAVLAKVSSEIDFAL

SEQ ID NO: 55 - protein, 385 aa, Thermoanaerobacter sp. X514
KNEPITITYSTGKDSTPATQKLVEAFEKKYPNIKVKVQELPNSTDDQHNSYVTALSAGDSSIDVLAMDIIWTPEFAAANWLLPLDDKFTKEMRDKFLPGPVEAVTYNGHVWAVPRFTDAGVLYYRKDIIDTPPKTWDELIQMAKENVGKGGTKYGIVFQGNQYEGLVCDALELIGSNGGSVLEGDKVTIDTPQAVAGLQYLIDLVKIAPPGVTTYQEEDARNVFQQGEAIFMRNWPYAWSLVNGDDSPVKGKVGIAPIPRGKDGEVGTPVLGGWNLGINKYSKHPEEAWKFIEFVTSEEGQKVTALEGGNLPTIKSLYQDKEVLAKNPYWADFYDVFITAKPRPVSPFYPQMSDSMQINFHKALTGEITAQQAIQNIAKDLNDII

SEQ ID NO: 56 - protein, 387 aa, Geobacillus kaustophilus HTA426
IVYARGQDSTKATEKIIEAFEKTHPNIDVEFREMPADTGKQHDAYVTMLNAQSSEIDVMDLDVIWPAEFAQAGYTLPLDRFIEKDGIDLGKYNQGALAAGNFNGKQWAMPKFIDAGMLFYRTDLVPKDKVPKTWDELLKEAKELKGKGGTKFGYLMQAKQYEGLVCNAVEFIASYGGQIVDKNGNVVINSPETIKGLKKMVEIVKSDVVPSNITTFTEPESHTAFIEGQSPFIRNWPYQYALANDKEQSKIVGKVGVAPLPAGDKGSAAALGGWMTAINKYSKHPKEAWEFVKFMTGPEGQKISAIYGGLAPTLPELFKDPDVLKANPFFAEEGFVNALNAAVPRPVVPNYPEISEIIQINVSKALAGELTVEQAVANMEKEMKAAL

SEQ ID NO: 57 - protein, 387 aa, Geobacillus thermodenitrificans NG80-2
IVYARGQDSTKATEKLIEAFEKAHPNIDVELREMPADTGKQHDAYVTMLNAQSSEIDVMDLDVIWPAEFAQAGYTLPLDRFIEKDGIDLSKYNQGALAAGNFNGKQWAMPKFIDTGMLFYRTDLVPEDKVPKTWDELLKTAKELKGQGGTKFGYLMQAKQYEGLVCNAVEFIASYGGQIVDKDGNVVVNSPEAIKGLKKMVEIVQSDVVPSNVTTFMEPESHTAFIEGQAPFIRNWPYQYALANDQEQSKIVGKVSVAPLPAGDKGSAAALGGWMTAINKYSKHPKEAWEFVKFMTGPEGQKISAVYGGLAPTLPELYEDEEVLKANPFFAEKGFVNALNAAVPRPVVPNYPEISEIIQINVSKALAGELTVEQAVANMEKEMKAAM

SEQ ID NO: 58 - protein, 389 aa, Fervidobacterium nodosum Rt17-B1
TMTAGAVGKELEVLYAQLDRFMKANPDIKVSVMPMPNSSTERHDLYVTYLASGEKEPTVLMLDVIWPAEFAPYLEDLTADKDYFELSKFLPGTVKAATVGGKTVAVPWFTDAGLLYYRKDLLQKYGFKEAPKTWDELVKMAKTITAKEKNMVGFVWQGARYEGLVCDFMEYLVSFGGDVLDDAGNVVVNSPAAVKALQFMVDLIYKEKVSPQAVTTYMEEEARRKFQNGEAVFMRNWPYAWALLNDPKESKVAGKVGVAPLPAGPSGKSAATLGGWMLGINKNATPEEKAAAKKLVKFLTSYDEQLYKAINAGQNPTMMDVYKNPELKKAAPFMVELYGMFINAVPRPRTAKYSEISDVIQKYVHAALTQQTTAQKAIEDMAKELNKVL

SEQ ID NO: 59 - protein, 468 aa, Artificial
  Substituion in SEQ ID NO 52
MQMKSKVKRWTSVALASSAAAALVVGCGQPNNTASQTSTNGSASTAASSASTVSVAGVRIAKPTHLVNYKNASGTIVWAESFTTGPTASELVSAFEKKYPKIKVKLQVQPSNTDTNRADLTASISGGSSTPDVYMGDVIWPAQFAHNQLAAPLSDDLPTSFWTRFSNGLVAGATYNGKVYAAPLFADTAFLYYRKDLLAKYHLPVPKTWQQLQTEASYIVKHGGAKYGFVWQGADYEGLTCDFDEYLADAGGSVLTNGKATLNTAAAKQALSFMRGLLTSGATPQSVDTFQEPQSENVFTQGNAVFLRNWSYAWSDSQNPQSSKVVGKVGVAPLPTFAGHGSSGYSTVGGWDLYLNPHTKNLAAALQFIDWMTSPQAQEILAANSEMPTIKAVADSPSLAKYSPVFALLPQVKFVSRPAQTPNYPAVSKAIYDNVNAALAGSVSVAQALKNANQQIQQALSGSGSGGL

SEQ ID NO: 60 - protein, 468 aa, Artificial
  Substituion in SEQ ID NO 52
MQMKSKVKRWTSVALASSAAAALVVGCGQPNNTASQTSTNGSASTAASSASTVSVAGVRIAKPTHLVNYKNASGTIVWAESFTTGPTASELVSAFEKKYPKIKVKLQVQPSNTDTNRADLTASISGGSSTPDVYMGDVIWPAQFAHNQLAAPLSDDLPTSFWTRFSNGLVAGATYNGKVYAAPLFADTAFLYYRKDLLAKYHLPVPKTWQQLQTEASYIVKHGGAKYGFVWQGADYEGLTCDFDEYLADAGGSVLTNGKATLNTAAAKQALSFMRGLITSGATPQSVDTFQEPQSENVFTQGNAVFLRNWSYAWSDSQNPQSSKVVGKVGVAPLPTFAGHGSSGYSTVGGWDLYLNPHTKNLAAALQFIDWMTSPQAQEILAANSEMPTIKAVADSPSLAKYSPVFALLPQVKFVSRPAQTPNYPAISKAIYDNVNAALAGSVSVAQALKNANQQIQQALSGSGSGGL

SEQ ID NO: 61 - protein, 468 aa, Artificial
  Substituion in SEQ ID NO 52
MQMKSKVKRWTSVALASSAAAALVVGCGQPNNTASQTSTNGSASTAASSASTVSVAGVRIAKPTHLVNYKNASGTIVWAESFTTGPTASELVSAFEKKYPKIKVKLQVQPSNTDTNRADLTASISGGSSTPDVYMGDVIWPAQFAHNQLAAPLSDDLPTSFWTRFSNGLVAGATYNGKVYAAPLFADTAFLYYRKDLLAKYHLPVPKTWQQLQTEASYIVKHGGAKYGFVWQGADYEGLTCDFDEYLADAGGSVLTNGKATLNTAAAKQALSFMRGLITSGATPQSVDTFQEPQSENVFTQGNAVFLRNWSYAWSDSQNPQSSKVVGKVGVAPLPTFAGHGSSGYSTVGGWDLYLNPHTKNLAAALQFIDWMTSPQAQEILAANSEMPTIKAVADSPSLAKYSPVFAILPQVKFVSRPAQTPNYPAVSKAIYDNVNAALAGSVSVAQALKNANQQIQQALSGSGSGGL

SEQ ID NO: 62 - protein, 468 aa, Artificial
  Substituion in SEQ ID NO 52
MQMKSKVKRWTSVALASSAAAALVVGCGQPNNTASQTSTNGSASTAASSASTVSVAGVRIAKPTHLVNYKNASGTIVWAESFTTGPTASELVSAFEKKYPKIKVKLQVQPSNTDTNRADLTASISGGSSTPDVYMGDVIWPAQFAHNQLAAPLSDDLPTSFWTRFSNGLVAGATYNGKVYAAPLFADTAFLYYRKDLLAKYHLPVPKTWQQLQTEASYIVKHGGAKYGFVWQGADYEGLTCDFDEYLADAGGSVLTQGKATLNTAAAKQALSFMRGLITSGATPQSVDTFQEPQSENVFTQGNAVFLRNWSYAWSDSQNPQSSKVVGKVGVAPLPTFAGHGSSGYSTVGGWDLYLNPHTKNLAAALQFIDWMTSPQAQEILAANSEMPTIKAVADSPSLAKYSPVFALLPQVKFVSRPAQTPNYPAVSKAIYDNVNAALAGSVSVAQALKNANQQIQQALSGSGSGGL

SEQ ID NO: 63 - protein, 468 aa, Artificial
  Substituion in SEQ ID NO 52
MQMKSKVKRWTSVALASSAAAALVVGCGQPNNTASQTSTNGSASTAASSASTVSVAGVRIAKPTHLVNYKNASGTIVWAESFTTGPTASELVSAFEKKYPKIKVKLQVQPSNTDTNRADLTASISGGSSTPDVYMGDVIWPAQFAHNQLAAPLSDDLPTSFWTRFSNGLVAGATYNGKVYAAPLFADTAFLYYRKDLLAKYHLPVPKTWQQLQTEASYIVKHGGAKYGFVWQGADYEGLTCDFDEYLADAGGSVLTNGKATLNTAAAKQALSFMRGLITSGATPQSVDTFQEPQSENVFTQGNAVFLRNWSYAWSDSQNPQSSKVVGKVGVAPLPTFAGHGSSGYSTVGGWDLYLNPHTKNLAAALQFIDWMTSPQAQEILAAQSEMPTIKAVADSPSLAKYSPVFALLPQVKFVSRPAQTPNYPAVSKAIYDNVNAALAGSVSVAQALKNANQQIQQALSGSGSGGL

SEQ ID NO: 64 - DNA, 1407 bp, Artificial
  Substituion in SEQ ID NO 53
gtgcagatgaagagcaaggtcaagcgttggacaagcgtcgcgctcgcgagctcggcagccgcggcactggtcgttggatgcggccagccaaacaacacggcgtcccagaccagcacgaacggaagcgcatccactgcggcgtcgtccgccagcacggtgagcgtggccggggtgcggatcgcgaagccgacccaccttgtgaactacaagaacgcctcgggaacgattgtctgggcggaatcgtttaccactggccccaccgccagcgagttggtctcggcgtttgaaaagaaataccccaagatcaaagtgaagttgcaggttcagccctcgaacaccgacaccaaccgcgccgacctgacggcgtccatcagcggcggatcttccacgccggacgtctacatgggcgacgtgatctggcctgctcagtttgcccacaatcagttggcggcgcctctctcggatgatctgcccacgtccttctggacgcgcttttcgaacggcttggtggcaggagccacgtataacggaaaggtctacgcggcgccgctgtttgccgatacagcattcctttattaccgcaaggacctgttggccaagtatcatctgcccgtgccgaagacgtggcagcaactgcaaacggaggcttcttacatcgtcaagcacggtggagcgaagtatgggttcgtctggcagggcgctgattacgaggggctcacctgcgacttcgacgagtacctggcggatgcaggcggcagcgtgctgacgaacggcaaagctacactgaacacagcggctgcgaaacaggcactctcgttcatgcgagggctcttaacgtccggtgccacgccccaatcggtggacacgttccaggagccccagtctgagaatgtgttcacgcaagggaatgccgtgttcctgcgcaactggtcctacgcgtggtcggattcccagaatccgcaaagttcgaaggtcgtgggcaaggtcggcgtagcgcctcttccgacatttgctggacacggctcgagcggctacagcacggtcggtggctgggacctgtacctcaacccgcacacgaagaatctggcagccgcccttcagttcattgactggatgacgagcccgcaggctcaggaaattctggcggccaactcggagatgcccaccatcaaggctgtggcggacagcccgtcgctcgccaagtacagcccggtgttcgccctgttgccacaggtgaagttcgtctcgcggccggcgcagacaccgaactatccggcggtctccaaggccatttacgacaacgtcaacgcggcgctggctggcagtgtgtctgtagcgcaggcgctgaagaacgcgaaccagcaaattcagcaggctctgagcggcagcggttcgggcggtctctga

SEQ ID NO: 65 - DNA, 1407 bp, Artificial
  Substituion in SEQ ID NO 53
gtgcagatgaagagcaaggtcaagcgttggacaagcgtcgcgctcgcgagctcggcagccgcggcactggtcgttggatgcggccagccaaacaacacggcgtcccagaccagcacgaacggaagcgcatccactgcggcgtcgtccgccagcacggtgagcgtggccggggtgcggatcgcgaagccgacccaccttgtgaactacaagaacgcctcgggaacgattgtctgggcggaatcgtttaccactggccccaccgccagcgagttggtctcggcgtttgaaaagaaataccccaagatcaaagtgaagttgcaggttcagccctcgaacaccgacaccaaccgcgccgacctgacggcgtccatcagcggcggatcttccacgccggacgtctacatgggcgacgtgatctggcctgctcagtttgcccacaatcagttggcggcgcctctctcggatgatctgcccacgtccttctggacgcgcttttcgaacggcttggtggcaggagccacgtataacggaaaggtctacgcggcgccgctgtttgccgatacagcattcctttattaccgcaaggacctgttggccaagtatcatctgcccgtgccgaagacgtggcagcaactgcaaacggaggcttcttacatcgtcaagcacggtggagcgaagtatgggttcgtctggcagggcgctgattacgaggggctcacctgcgacttcgacgagtacctggcggatgcaggcggcagcgtgctgacgaacggcaaagctacactgaacacagcggctgcgaaacaggcactctcgttcatgcgagggctcatcacgtccggtgccacgccccaatcggtggacacgttccaggagccccagtctgagaatgtgttcacgcaagggaatgccgtgttcctgcgcaactggtcctacgcgtggtcggattcccagaatccgcaaagttcgaaggtcgtgggcaaggtcggcgtagcgcctcttccgacatttgctggacacggctcgagcggctacagcacggtcggtggctgggacctgtacctcaacccgcacacgaagaatctggcagccgcccttcagttcattgactggatgacgagcccgcaggctcaggaaattctggcggccaactcggagatgcccaccatcaaggctgtggcggacagcccgtcgctcgccaagtacagcccggtgttcgccctgttgccacaggtgaagttcgtctcgcggccggcgcagacaccgaactatccggcgatttccaaggccatttacgacaacgtcaacgcggcgctggctggcagtgtgtctgtagcgcaggcgctgaagaacgcgaaccagcaaattcagcaggctctgagcggcagcggttcgggcggtctctga

SEQ ID NO: 66 - DNA, 1407 bp, Artificial
  Substituion in SEQ ID NO 53
gtgcagatgaagagcaaggtcaagcgttggacaagcgtcgcgctcgcgagctcggcagccgcggcactggtcgttggatgcggccagccaaacaacacggcgtcccagaccagcacgaacggaagcgcatccactgcggcgtcgtccgccagcacggtgagcgtggccggggtgcggatcgcgaagccgacccaccttgtgaactacaagaacgcctcgggaacgattgtctgggcggaatcgtttaccactggccccaccgccagcgagttggtctcggcgtttgaaaagaaataccccaagatcaaagtgaagttgcaggttcagccctcgaacaccgacaccaaccgcgccgacctgacggcgtccatcagcggcggatcttccacgccggacgtctacatgggcgacgtgatctggcctgctcagtttgcccacaatcagttggcggcgcctctctcggatgatctgcccacgtccttctggacgcgcttttcgaacggcttggtggcaggagccacgtataacggaaaggtctacgcggcgccgctgtttgccgatacagcattcctttattaccgcaaggacctgttggccaagtatcatctgcccgtgccgaagacgtggcagcaactgcaaacggaggcttcttacatcgtcaagcacggtggagcgaagtatgggttcgtctggcagggcgctgattacgaggggctcacctgcgacttcgacgagtacctggcggatgcaggcggcagcgtgctgacgaacggcaaagctacactgaacacagcggctgcgaaacaggcactctcgttcatgcgagggctcatcacgtccggtgccacgccccaatcggtggacacgttccaggagccccagtctgagaatgtgttcacgcaagggaatgccgtgttcctgcgcaactggtcctacgcgtggtcggattcccagaatccgcaaagttcgaaggtcgtgggcaaggtcggcgtagcgcctcttccgacatttgctggacacggctcgagcggctacagcacggtcggtggctgggacctgtacctcaacccgcacacgaagaatctggcagccgcccttcagttcattgactggatgacgagcccgcaggctcaggaaattctggcggccaactcggagatgcccaccatcaaggctgtggcggacagcccgtcgctcgccaagtacagcccggtgttcgccattttgccacaggtgaagttcgtctcgcggccggcgcagacaccgaactatccggcggtctccaaggccatttacgacaacgtcaacgcggcgctggctggcagtgtgtctgtagcgcaggcgctgaagaacgcgaaccagcaaattcagcaggctctgagcggcagcggttcgggcggtctctga

SEQ ID NO: 67 - DNA, 1407 bp, Artificial
  Substituion in SEQ ID NO 53
gtgcagatgaagagcaaggtcaagcgttggacaagcgtcgcgctcgcgagctcggcagccgcggcactggtcgttggatgcggccagccaaacaacacggcgtcccagaccagcacgaacggaagcgcatccactgcggcgtcgtccgccagcacggtgagcgtggccggggtgcggatcgcgaagccgacccaccttgtgaactacaagaacgcctcgggaacgattgtctgggcggaatcgtttaccactggccccaccgccagcgagttggtctcggcgtttgaaaagaaataccccaagatcaaagtgaagttgcaggttcagccctcgaacaccgacaccaaccgcgccgacctgacggcgtccatcagcggcggatcttccacgccggacgtctacatgggcgacgtgatctggcctgctcagtttgcccacaatcagttggcggcgcctctctcggatgatctgcccacgtccttctggacgcgcttttcgaacggcttggtggcaggagccacgtataacggaaaggtctacgcggcgccgctgtttgccgatacagcattcctttattaccgcaaggacctgttggccaagtatcatctgcccgtgccgaagacgtggcagcaactgcaaacggaggcttcttacatcgtcaagcacggtggagcgaagtatgggttcgtctggcagggcgctgattacgaggggctcacctgcgacttcgacgagtacctggcggatgcaggcggcagcgtgctgacgcaaggcaaagctacactgaacacagcggctgcgaaacaggcactctcgttcatgcgagggctcatcacgtccggtgccacgccccaatcggtggacacgttccaggagccccagtctgagaatgtgttcacgcaagggaatgccgtgttcctgcgcaactggtcctacgcgtggtcggattcccagaatccgcaaagttcgaaggtcgtgggcaaggtcggcgtagcgcctcttccgacatttgctggacacggctcgagcggctacagcacggtcggtggctgggacctgtacctcaacccgcacacgaagaatctggcagccgcccttcagttcattgactggatgacgagcccgcaggctcaggaaattctggcggccaactcggagatgcccaccatcaaggctgtggcggacagcccgtcgctcgccaagtacagcccggtgttcgccctgttgccacaggtgaagttcgtctcgcggccggcgcagacaccgaactatccggcggtctccaaggccatttacgacaacgtcaacgcggcgctggctggcagtgtgtctgtagcgcaggcgctgaagaacgcgaaccagcaaattcagcaggctctgagcggcagcggttcgggcggtctctga

SEQ ID NO: 68 - DNA, 1407 bp, Artificial
  Substituion in SEQ ID NO 53
gtgcagatgaagagcaaggtcaagcgttggacaagcgtcgcgctcgcgagctcggcagccgcggcactggtcgttggatgcggccagccaaacaacacggcgtcccagaccagcacgaacggaagcgcatccactgcggcgtcgtccgccagcacggtgagcgtggccggggtgcggatcgcgaagccgacccaccttgtgaactacaagaacgcctcgggaacgattgtctgggcggaatcgtttaccactggccccaccgccagcgagttggtctcggcgtttgaaaagaaataccccaagatcaaagtgaagttgcaggttcagccctcgaacaccgacaccaaccgcgccgacctgacggcgtccatcagcggcggatcttccacgccggacgtctacatgggcgacgtgatctggcctgctcagtttgcccacaatcagttggcggcgcctctctcggatgatctgcccacgtccttctggacgcgcttttcgaacggcttggtggcaggagccacgtataacggaaaggtctacgcggcgccgctgtttgccgatacagcattcctttattaccgcaaggacctgttggccaagtatcatctgcccgtgccgaagacgtggcagcaactgcaaacggaggcttcttacatcgtcaagcacggtggagcgaagtatgggttcgtctggcagggcgctgattacgaggggctcacctgcgacttcgacgagtacctggcggatgcaggcggcagcgtgctgacgaacggcaaagctacactgaacacagcggctgcgaaacaggcactctcgttcatgcgagggctcatcacgtccggtgccacgccccaatcggtggacacgttccaggagccccagtctgagaatgtgttcacgcaagggaatgccgtgttcctgcgcaactggtcctacgcgtggtcggattcccagaatccgcaaagttcgaaggtcgtgggcaaggtcggcgtagcgcctcttccgacatttgctggacacggctcgagcggctacagcacggtcggtggctgggacctgtacctcaacccgcacacgaagaatctggcagccgcccttcagttcattgactggatgacgagcccgcaggctcaggaaattctggcggcccaatcggagatgcccaccatcaaggctgtggcggacagcccgtcgctcgccaagtacagcccggtgttcgccctgttgccacaggtgaagttcgtctcgcggccggcgcagacaccgaactatccggcggtctccaaggccatttacgacaacgtcaacgcggcgctggctggcagtgtgtctgtagcgcaggcgctgaagaacgcgaaccagcaaattcagcaggctctgagcggcagcggttcgggcggtctctga

SEQ ID NO: 69 - protein, 330 aa, Alicyclobacillus acidocaldarius
MSTMLASEGEGRRARMSKAMEGHASFQTDGRRASVVRHDVRAGFGMLTPAGIVILAVTIFPILYSVWMSFNNIQLTENGFQFTFNGIQNYVDVYSAPLFWHSVWFTVYYSIVTVAIELFLGLLIALAIQNVEKLKSVSVVVMLIPWSLITVISAEMWSYIYNGVYGVLNAILQGLGFIHSPINWTGEPVTAVIALMAADIWKTTPFVVIILLSGLQMIPKDYYEAARIDGANGWQIFWNVTFPQLRGSIAIAGLFRILQAFGIFDLPFVLTQGGPGSTTTSLAMLGEETLFTNLHFGLGAAVAVSTVILILGACLIFLSAFRGMVGEEAQ

SEQ ID NO: 70 - DNA, 993 bp, Alicyclobacillus acidocaldarius
gtgtctacgatgctcgcaagcgaaggagaagggaggcgagcgcgcatgtcaaaggcgatggaagggcatgcatcgtttcaaaccgatggcaggcgagcgagcgtcgttcgccacgacgttcgcgcgggctttgggatgttgaccccagccggcattgtcatcctggccgtgaccattttccccatcctctattccgtgtggatgagcttcaataacattcaattgacggagaacggatttcagttcacgttcaacggcattcaaaactacgtcgacgtctattccgcccccctgttctggcacagtgtgtggttcacggtgtattactcgattgtcacggtcgcgatcgagttgtttttggggctgctcattgcgcttgccatccagaacgtggagaaattgaagagcgtctcggtcgtggtgatgctcattccttggtcgctcatcacggtcatttccgccgagatgtggagttacatctacaacggcgtgtatggcgtcctgaacgccatcctccaaggactgggtttcatccacagccccatcaactggaccggtgagccggtgacggctgtgatcgccctcatggcagcggatatttggaaaactacaccgtttgtcgtcatcatcctgttgagcgggctgcagatgatcccgaaagactactacgaggcggcgcgcatcgacggcgcgaacggttggcagatcttttggaacgtcacgtttcctcagttgcggggaagcatcgccatcgcgggcctgtttcgaattcttcaggcgttcggtatcttcgacctgccgttcgtgctcacgcagggtggccctggttcgacgaccacgtccctcgccatgctgggtgaggaaacgctgttcacgaaccttcactttggcttgggagcagcggtcgccgtcagcacggtgatcctcatcttaggggcttgtctaatattcctgtccgcctttcgcgggatggtcggggaggaagcgcaatga

SEQ ID NO: 71 - protein, 286 aa, Saccharopolyspora erythraea NRRL 2338
RLGWLYTAPALIVVVAVTIFPILFSVVLSFTRVRVTYGGFRVEELTLDNYVALFQSSEWHYAVLFTFFYTVVTVTIELVLGVLAALVLERLGAARGWVLALLLIPWSMITVISAQLWAFIYNSTYGVATWLLEALFGTAPIILGTPVPAITGMMVADIWKTTPFVTIIVLAGLVMLSREVYESAEIDGANAWTTFWRVTLPQLKSTLAVAVLFRILQAFGVFDLPFVLTTGGPGTATQSLAILGYKTLFQDLHIGPGAAIATSTGLLVIGGCLLFLKAFRAQVGKE

SEQ ID NO: 72 - protein, 277 aa, Cyanothece sp. CCY0110
MREENKTAWFMLIPALAVLAFVFAYPIGRAFWLSLFTENLGTQLQPVFSGFTNYLRMAGDGRFWQSMWNTWVFTGVSVFLELVLGMIVALVLNQAFFCRGAVRTISMIPWALPTAIMGLAWAWIFNDQYGVVNDILQRLGIINTEINWLGDPTLAMIALIVADVWKTTPFISIILLAGLQSIPKDLYEAHSLDGANPWQSFYQITLPLVMPQVLIALLFRFAQAFGIFDLVQVMTGGGPAGATETVSIYIYSTVMRYLDFGYGAALVVITFLLLIAA

SEQ ID NO: 73 - protein, 275 aa, Thermoanaerobacter sp. X514
GYILVAPALLCIIAIALYPVLNTFKLSLYYMKLQLPGLTHFVGLQNYITLSSDSRFWSATLNTVFFTVVSVALELVLGMIMALLMNKKFKGIGLVRAAVLIPWAIPTVISALMWKFIYNDQFGVLNDILMKVGLINSYKAWLGSPSSAMSAAIFADVWKTAPFMALLLLAGLQNISQDLYEAAKVDGAGSIRQFFRITLPLLKPTILVALIFRTLDAFRVFDLIFVMTGGGPGNSTETLSIYAYKTLFRNLDFGIGSAIAVIIFIFVFIFAMFYI

SEQ ID NO: 74 - protein, 269 aa, Synechococcus elongatus PCC 6301
PALLTITGVFAYPLLRAAWLSLQALNLNTQLQPVFIGLANYQRLWGDSRFWGDLFNTTVFTVTSVSLELVLGLAIALLLHQPSRWRGPLRTIALLPWVLPTAVMALGWAWIFNDPYGVWNDWLQQLGWIAAPINWLGNPRWAWLTLVAADVWKTTPFVAILLLAGRQAIPEDLYEAHCLEGATAWQSFWQITLPLLRPQLAIALLFRSAQAFGLFDLVKVMTGGGPANSTETLALYAYTTALRYLDFGYGATLAIVTAAILAAGLGLIW

SEQ ID NO: 75 - protein, 294 aa, Nocardioides sp. JS614
GRRLRVRGGQHEGRFALLLLLPAAVVVFGVVLWPVVRTLVVSLYDVDSAMPGSYPFVGLDNYVRVFQDDRFYSVLGHTMYFTLVSTFLELALGIAVALLLNAPLKARWLWRSIVVLPWALPTIVNGALWRWIYNGQYGALNGLLDTLGISETPTQWLGEPFLALNMVIIADVWKNTSIVVFFILAGLQTIPSDLYEAARVDGAGPWRAFWRLTIPMLAPSIAVVLILRTIEAFKVFDIIYVMTGGGPASGTQTIAFYTYLQAFSNQLFGYGAALAYLIVLAVFALAMAYLRILR

SEQ ID NO: 76 - protein, 330 aa, Artificial
  Substituion in SEQ ID NO 69
MSTMLASEGEGRRARMSKAMEGHASFQTDGRRASVVRHDVRAGFGMLTPAGIVILAVTIFPILYSVWMSFNNIQLTENGFQFTFNGIQNYVDVYSAPLFWHSVWFTVYYSIVTVAIELFLGLLIALAIQNVEKLKSVSVVVMLIPWSLITVISAEMWSYIYNGVYGVLNAILQGLGFIHSPINWTGEPVTAVIALMAADIWKTTPFVVIILLSGLQMIPKDYYEAARIDGANGWQIFWNVTFPQLRGSIALAGLFRILQAFGIFDLPFVLTQGGPGSTTTSLAMLGEETLFTNLHFGLGAAVAVSTVILILGACLIFLSAFRGMVGEEAQ

SEQ ID NO: 77 - protein, 330 aa, Artificial
  Substituion in SEQ ID NO 69
MSTMLASEGEGRRARMSKAMEGHASFQTDGRRASVVRHDVRAGFGMLTPAGIVILAVTIFPILYSVWMSFNNIQLTENGFQFTFNGIQNYVDVYSAPLFWHSVWFTVYYSIVTVALELFLGLLIALAIQNVEKLKSVSVVVMLIPWSLITVISAEMWSYIYNGVYGVLNAILQGLGFIHSPINWTGEPVTAVIALMAADIWKTTPFVVIILLSGLQMIPKDYYEAARIDGANGWQIFWNVTFPQLRGSIAIAGLFRILQAFGIFDLPFVLTQGGPGSTTTSLAMLGEETLFTNLHFGLGAAVAVSTVILILGACLIFLSAFRGMVGEEAQ

SEQ ID NO: 78 - protein, 330 aa, Artificial
  Substituion in SEQ ID NO 69
MSTMLASEGEGRRARMSKAMEGHASFQTDGRRASVVRHDVRAGFGMLTPAGIVILAVTIFPILYSVWMSFNNIQLTENGFQFTFNGIQNYVDVYSAPLFWHSVWFTIYYSIVTVAIELFLGLLIALAIQNVEKLKSVSVVVMLIPWSLITVISAEMWSYIYNGVYGVLNAILQGLGFIHSPINWTGEPVTAVIALMAADIWKTTPFVVIILLSGLQMIPKDYYEAARIDGANGWQIFWNVTFPQLRGSIAIAGLFRILQAFGIFDLPFVLTQGGPGSTTTSLAMLGEETLFTNLHFGLGAAVAVSTVILILGACLIFLSAFRGMVGEEAQ

SEQ ID NO: 79 - protein, 330 aa, Artificial
  Substituion in SEQ ID NO 69
MSTMLASEGEGRRARMSKAMEGHASFQTDGRRASVVRHDVRAGFGMLTPAGIVILAVTIFPILYSVWMSFNNIQLTENGFQFTFNGIQNYVDVYSAPLFWHSVWFTVYYSIVTVAIELFLGLLIALAIQNVEKLKSVSVVVMLIPWSLITVISAEMWSYIYNGVYGVLNAILQGLGFIHSPINWTGEPVTAVIALMAADIWKTTPFVVIILLSGLQMIPKDYYEAARIDGANGWQIFWNVTFPQLRGSIAIAGLFRILQAFGIFDLPFVITQGGPGSTTTSLAMLGEETLFTNLHFGLGAAVAVSTVILILGACLIFLSAFRGMVGEEAQ

SEQ ID NO: 80 - protein, 330 aa, Artificial
  Substituion in SEQ ID NO 69
MSTMLASEGEGRRARMSKAMEGHASFQTDGRRASVVRHDVRAGFGMLTPAGIVILAVTIFPILYSVWMSFNNIQLTENGFQFTFNGIQNYVDVYSAPLFWHSVWFTVYYSIVTVAIELFLGLLIALAIQNVEKLKSVSVVVMLIPWSLITVISAEMWSYIYNGVYGVLNAILQGLGFIHSPINWTGEPVTAVIALMAADIWKTTPFVVIILLSGLQMIPKDYYEAARIEGANGWQIFWNVTFPQLRGSIAIAGLFRILQAFGIFDLPFVLTQGGPGSTTTSLAMLGEETLFTNLHFGLGAAVAVSTVILILGACLIFLSAFRGMVGEEAQ

SEQ ID NO: 81 - DNA, 993 bp, Artificial
  Substituion in SEQ ID NO 70
gtgtctacgatgctcgcaagcgaaggagaagggaggcgagcgcgcatgtcaaaggcgatggaagggcatgcatcgtttcaaaccgatggcaggcgagcgagcgtcgttcgccacgacgttcgcgcgggctttgggatgttgaccccagccggcattgtcatcctggccgtgaccattttccccatcctctattccgtgtggatgagcttcaataacattcaattgacggagaacggatttcagttcacgttcaacggcattcaaaactacgtcgacgtctattccgcccccctgttctggcacagtgtgtggttcacggtgtattactcgattgtcacggtcgcgatcgagttgtttttggggctgctcattgcgcttgccatccagaacgtggagaaattgaagagcgtctcggtcgtggtgatgctcattccttggtcgctcatcacggtcatttccgccgagatgtggagttacatctacaacggcgtgtatggcgtcctgaacgccatcctccaaggactgggtttcatccacagccccatcaactggaccggtgagccggtgacggctgtgatcgccctcatggcagcggatatttggaaaactacaccgtttgtcgtcatcatcctgttgagcgggctgcagatgatcccgaaagactactacgaggcggcgcgcatcgacggcgcgaacggttggcagatcttttggaacgtcacgtttcctcagttgcggggaagcatcgccttagcgggcctgtttcgaattcttcaggcgttcggtatcttcgacctgccgttcgtgctcacgcagggtggccctggttcgacgaccacgtccctcgccatgctgggtgaggaaacgctgttcacgaaccttcactttggcttgggagcagcggtcgccgtcagcacggtgatcctcatcttaggggcttgtctaatattcctgtccgcctttcgcgggatggtcggggaggaagcgcaatga

SEQ ID NO: 82 - DNA, 993 bp, Artificial
  Substituion in SEQ ID NO 70
gtgtctacgatgctcgcaagcgaaggagaagggaggcgagcgcgcatgtcaaaggcgatggaagggcatgcatcgtttcaaaccgatggcaggcgagcgagcgtcgttcgccacgacgttcgcgcgggctttgggatgttgaccccagccggcattgtcatcctggccgtgaccattttccccatcctctattccgtgtggatgagcttcaataacattcaattgacggagaacggatttcagttcacgttcaacggcattcaaaactacgtcgacgtctattccgcccccctgttctggcacagtgtgtggttcacggtgtattactcgattgtcacggtcgcgttagagttgtttttggggctgctcattgcgcttgccatccagaacgtggagaaattgaagagcgtctcggtcgtggtgatgctcattccttggtcgctcatcacggtcatttccgccgagatgtggagttacatctacaacggcgtgtatggcgtcctgaacgccatcctccaaggactgggtttcatccacagccccatcaactggaccggtgagccggtgacggctgtgatcgccctcatggcagcggatatttggaaaactacaccgtttgtcgtcatcatcctgttgagcgggctgcagatgatcccgaaagactactacgaggcggcgcgcatcgacggcgcgaacggttggcagatcttttggaacgtcacgtttcctcagttgcggggaagcatcgccatcgcgggcctgtttcgaattcttcaggcgttcggtatcttcgacctgccgttcgtgctcacgcagggtggccctggttcgacgaccacgtccctcgccatgctgggtgaggaaacgctgttcacgaaccttcactttggcttgggagcagcggtcgccgtcagcacggtgatcctcatcttaggggcttgtctaatattcctgtccgcctttcgcgggatggtcggggaggaagcgcaatga

SEQ ID NO: 83 - DNA, 993 bp, Artificial
  Substituion in SEQ ID NO 70
gtgtctacgatgctcgcaagcgaaggagaagggaggcgagcgcgcatgtcaaaggcgatggaagggcatgcatcgtttcaaaccgatggcaggcgagcgagcgtcgttcgccacgacgttcgcgcgggctttgggatgttgaccccagccggcattgtcatcctggccgtgaccattttccccatcctctattccgtgtggatgagcttcaataacattcaattgacggagaacggatttcagttcacgttcaacggcattcaaaactacgtcgacgtctattccgcccccctgttctggcacagtgtgtggttcacgatttattactcgattgtcacggtcgcgatcgagttgtttttggggctgctcattgcgcttgccatccagaacgtggagaaattgaagagcgtctcggtcgtggtgatgctcattccttggtcgctcatcacggtcatttccgccgagatgtggagttacatctacaacggcgtgtatggcgtcctgaacgccatcctccaaggactgggtttcatccacagccccatcaactggaccggtgagccggtgacggctgtgatcgccctcatggcagcggatatttggaaaactacaccgtttgtcgtcatcatcctgttgagcgggctgcagatgatcccgaaagactactacgaggcggcgcgcatcgacggcgcgaacggttggcagatcttttggaacgtcacgtttcctcagttgcggggaagcatcgccatcgcgggcctgtttcgaattcttcaggcgttcggtatcttcgacctgccgttcgtgctcacgcagggtggccctggttcgacgaccacgtccctcgccatgctgggtgaggaaacgctgttcacgaaccttcactttggcttgggagcagcggtcgccgtcagcacggtgatcctcatcttaggggcttgtctaatattcctgtccgcctttcgcgggatggtcggggaggaagcgcaatga

SEQ ID NO: 84 - DNA, 993 bp, Artificial
  Substituion in SEQ ID NO 70
gtgtctacgatgctcgcaagcgaaggagaagggaggcgagcgcgcatgtcaaaggcgatggaagggcatgcatcgtttcaaaccgatggcaggcgagcgagcgtcgttcgccacgacgttcgcgcgggctttgggatgttgaccccagccggcattgtcatcctggccgtgaccattttccccatcctctattccgtgtggatgagcttcaataacattcaattgacggagaacggatttcagttcacgttcaacggcattcaaaactacgtcgacgtctattccgcccccctgttctggcacagtgtgtggttcacggtgtattactcgattgtcacggtcgcgatcgagttgtttttggggctgctcattgcgcttgccatccagaacgtggagaaattgaagagcgtctcggtcgtggtgatgctcattccttggtcgctcatcacggtcatttccgccgagatgtggagttacatctacaacggcgtgtatggcgtcctgaacgccatcctccaaggactgggtttcatccacagccccatcaactggaccggtgagccggtgacggctgtgatcgccctcatggcagcggatatttggaaaactacaccgtttgtcgtcatcatcctgttgagcgggctgcagatgatcccgaaagactactacgaggcggcgcgcatcgacggcgcgaacggttggcagatcttttggaacgtcacgtttcctcagttgcggggaagcatcgccatcgcgggcctgtttcgaattcttcaggcgttcggtatcttcgacctgccgttcgtgattacgcagggtggccctggttcgacgaccacgtccctcgccatgctgggtgaggaaacgctgttcacgaaccttcactttggcttgggagcagcggtcgccgtcagcacggtgatcctcatcttaggggcttgtctaatattcctgtccgcctttcgcgggatggtcggggaggaagcgcaatga

SEQ ID NO: 85 - DNA, 993 bp, Artificial
  Substituion in SEQ ID NO 70
gtgtctacgatgctcgcaagcgaaggagaagggaggcgagcgcgcatgtcaaaggcgatggaagggcatgcatcgtttcaaaccgatggcaggcgagcgagcgtcgttcgccacgacgttcgcgcgggctttgggatgttgaccccagccggcattgtcatcctggccgtgaccattttccccatcctctattccgtgtggatgagcttcaataacattcaattgacggagaacggatttcagttcacgttcaacggcattcaaaactacgtcgacgtctattccgcccccctgttctggcacagtgtgtggttcacggtgtattactcgattgtcacggtcgcgatcgagttgtttttggggctgctcattgcgcttgccatccagaacgtggagaaattgaagagcgtctcggtcgtggtgatgctcattccttggtcgctcatcacggtcatttccgccgagatgtggagttacatctacaacggcgtgtatggcgtcctgaacgccatcctccaaggactgggtttcatccacagccccatcaactggaccggtgagccggtgacggctgtgatcgccctcatggcagcggatatttggaaaactacaccgtttgtcgtcatcatcctgttgagcgggctgcagatgatcccgaaagactactacgaggcggcgcgcatcgaaggcgcgaacggttggcagatcttttggaacgtcacgtttcctcagttgcggggaagcatcgccatcgcgggcctgtttcgaattcttcaggcgttcggtatcttcgacctgccgttcgtgctcacgcagggtggccctggttcgacgaccacgtccctcgccatgctgggtgaggaaacgctgttcacgaaccttcactttggcttgggagcagcggtcgccgtcagcacggtgatcctcatcttaggggcttgtctaatattcctgtccgcctttcgcgggatggtcggggaggaagcgcaatga

SEQ ID NO: 86 - protein, 293 aa, Alicyclobacillus acidocaldarius
MSNIPVRLSRDGRGGSAMRKPLYQRIIGYVVLIFFLVVILLPFYWMFVTSFEPNSDISAYPPAYFPHHWTLSHYEEAFGQFHFGRYILNSVIVSITSTFFVLLFGSMAGFAIARLPIKAKQPMLILLLIISVFPPLVVITPLYMLLRDVGWLDSYQALVIPYTAFNLPFAIWILRNYFLQVPGALFEAAKIDGASVFMSYWRIFLPLTTPGLFTAAVFTFVACWTEFFMALVFNPDNTMRTIPVGIALFSGQYTVPYGTIFAGSVVSIVPIVILVVIFRRWIVSGLTQGAVKG

SEQ ID NO: 87 - DNA, 882 bp, Alicyclobacillus acidocaldarius
ttgtctaatattcctgtccgcctttcgcgggatggtcggggaggaagcgcaatgagaaagccgttgtatcaacgcatcatcggctatgtcgtgctcattttctttctcgtcgtgatcctgctcccattctattggatgttcgtcacgtcgttcgagcccaattccgacatcagcgcttatccgccggcgtacttcccgcatcattggacgctttctcattatgaagaggccttcggccaatttcactttggacggtacatcctcaacagcgtgattgtctccatcacatcgacgttcttcgtgcttctgttcggatccatggcggggtttgcgattgcacggcttcccatcaaggccaagcagccgatgctcatccttctgctcatcatctcggtgtttccgccgctcgtcgtgatcacgcccctgtatatgttgcttcgcgacgtggggtggctcgactcctatcaggcgctcgtcattccgtatacggcgttcaacttgccgtttgccatttggattctgcggaactattttttgcaggtgccaggtgccttgtttgaagcggctaaaatcgacggtgcgtccgtgttcatgtcgtactggcgcatcttcctgccgctcaccacgccggggctctttacggcagccgtgttcacgttcgtcgcctgctggacggagttcttcatggcgctcgtgttcaaccctgacaacaccatgcgcaccattccggttggcattgcgctgttcagcgggcagtacacggttccgtacggcaccatctttgctggctccgtggtgtcgattgtccccatcgtcattctcgtggtgatcttccgccgctggatcgtgtcggggttgacgcagggcgctgtcaaaggctaa

SEQ ID NO: 88 - protein, 252 aa, Saccharopolyspora erythraea NRRL 2338
PLYWMVVNSLKGGAELGATPPTPWPSDPTVDNYVQAFAGNGFGGYLVNSLVVSVVSTVVVVSLATFAGYALARLPMRGRRPLMIALLMISVFPAIAVVTPLYLVERQLGLLNSHLGLIIPYVAFNLPLAIWIMRNYMLGVPTALEDAATVDGASPTRTVLQIVVPVVRPGILTAAIFTFTATWTEFLMALTFNSQNDYRTIPVGISLFGSSFEVPHGTIFAAAVSATAPIAILVLVFRRSVVSGLASGAVKG

SEQ ID NO: 89 - protein, 274 aa, Thermoanaerobacter sp. X514
KNTINQIIFYIFLTIFLVYIIFPFLWQTLTSFKTPQELFSIPPTWIPSKIYTGYYINVFTKRPFLTYLKNSFIVASSTTLFSLFVSSFAAYALARLKFKGKAIILSLVLSVSMFPGIAIVSPLFIFLKNVNLLNSYLGLILTYTTFAIPLSLWILTSFFKEIPFELEESAKVDGATPMQAFLKIIMPLATPGMFTTAILTFIAAWNEFLFALVFNTQDSMRTVPVGIAMFPGEHDLPWGDIAAASVVVTVPLIIMVLIFQKRIISGLTAGAVKG

SEQ ID NO: 90 - protein, 252 aa, Geobacillus kaustophilus HTA426
PFLWVLLSSIKPLSELFGDKAFDWFTSHPTLKSYVSVFVNYPFLRYLWNSTVVATITTVYTVFVAAFAAYAIARLEFKGKTVILGLVLAVSMFPQIATISPIYMFVKKFGLTNSYLGLIIPYTTFALPLSIWLLVTFFRKIPFDLEEAAKMDGATPMQTYFKIILPLAVPGVFTTSILVFIAAWNEFLFALTINTAEKYKTVPVGIAMFQGQYTIPWGEISAATVIVTIPLVIMVLLFQRRIVSGLTSGSVK

SEQ ID NO: 91 - protein, 252 aa, Geobacillus thermodenitrificans NG80-2
PFLWVLLSSIKPLSELFGDKAFQWFTSHPTLKSYISVFVNYPFLRYLWNSTVVATITTVYTVFVAAFAAYAIARLEFRGKTVILGLVLAVSMFPQIATISPIYMFVKKFGLTNSYLGLIIPYTTFALPLSIWLLVTFFRKIPFDLEEAAKIDGATPMQTYFKVILPLAVPGVFTTSILVFIAAWNEFLFALTINTAEKYKTVPVGIAMFQGQYTIPWGEISAATVIVTIPLVIMVLLFQRRIVSGLTSGSVK

SEQ ID NO: 92 - protein, 250 aa, Oceanobacillus iheyensis HTE831
PFIWVFLTSIKPVNEIFSSFKWFTSNPTLSSYEAALTNRPLLRYMLNSFVVSLLTTVLSLTFAAFTAYAVTRLPIKGKGLILGLVLAASMFPQIAIISPMFNLVTNLGLRNSYLGLIIPYITISLPLAIWILSTFFKKIPYELEESAKLDGASPFQTFRKIILPLATPGIFTTGILVFIAAWNEYLFALTINSDDQWRTVPVGISMYQSEFSIPWGDISAATVIVTIPIVVLVLIFQRRIVSGLTSGSVK

SEQ ID NO: 93 - protein, 293 aa, Artificial
  Substituion in SEQ ID NO 86
MSNIPVRLSRDGRGGSAMRKPLYQRIIGYVVLIFFLVVILLPFYWMFVTSFEPNSDISAYPPAYFPHHWTLSHYEEAFGQFHFGRYILNSVIVSITSTFFVLLFGSMAGFALARLPIKAKQPMLILLLIISVFPPLVVITPLYMLLRDVGWLDSYQALVIPYTAFNLPFAIWILRNYFLQVPGALFEAAKIDGASVFMSYWRIFLPLTTPGLFTAAVFTFVACWTEFFMALVFNPDNTMRTIPVGIALFSGQYTVPYGTIFAGSVVSIVPIVILVVIFRRWIVSGLTQGAVKG

SEQ ID NO: 94 - protein, 293 aa, Artificial
  Substituion in SEQ ID NO 86
MSNIPVRLSRDGRGGSAMRKPLYQRIIGYVVLIFFLVVILLPFYWMFVTSFEPNSDISAYPPAYFPHHWTLSHYEEAFGQFHFGRYILNSVIVSITSTFFVLLFGSMAGFAIARLPIKAKQPMLILLLIISIFPPLVVITPLYMLLRDVGWLDSYQALVIPYTAFNLPFAIWILRNYFLQVPGALFEAAKIDGASVFMSYWRIFLPLTTPGLFTAAVFTFVACWTEFFMALVFNPDNTMRTIPVGIALFSGQYTVPYGTIFAGSVVSIVPIVILVVIFRRWIVSGLTQGAVKG

SEQ ID NO: 95 - protein, 293 aa, Artificial
  Substituion in SEQ ID NO 86
MSNIPVRLSRDGRGGSAMRKPLYQRIIGYVVLIFFLVVILLPFYWMFVTSFEPNSDISAYPPAYFPHHWTLSHYEEAFGQFHFGRYILNSVIVSITSTFFVLLFGSMAGFAIARLPIKAKQPMLILLLIISVFPPLVVITPLYMLLRDVGWLDSYQALVIPYTAFNLPFAIWILRNYFLQVPGALFEAARIDGASVFMSYWRIFLPLTTPGLFTAAVFTFVACWTEFFMALVFNPDNTMRTIPVGIALFSGQYTVPYGTIFAGSVVSIVPIVILVVIFRRWIVSGLTQGAVKG

SEQ ID NO: 96 - protein, 293 aa, Artificial
  Substituion in SEQ ID NO 86
MSNIPVRLSRDGRGGSAMRKPLYQRIIGYVVLIFFLVVILLPFYWMFVTSFEPNSDISAYPPAYFPHHWTLSHYEEAFGQFHFGRYILNSVIVSITSTFFVLLFGSMAGFAIARLPIKAKQPMLILLLIISVFPPLVVITPLYMLLRDVGWLDSYQALVIPYTAFNLPFAIWILRNYFLQVPGALFEAAKIDGASVFMSYWRIFIPLTTPGLFTAAVFTFVACWTEFFMALVFNPDNTMRTIPVGIALFSGQYTVPYGTIFAGSVVSIVPIVILVVIFRRWIVSGLTQGAVKG

SEQ ID NO: 97 - protein, 293 aa, Artificial
  Substituion in SEQ ID NO 86
MSNIPVRLSRDGRGGSAMRKPLYQRIIGYVVLIFFLVVILLPFYWMFVTSFEPNSDISAYPPAYFPHHWTLSHYEEAFGQFHFGRYILNSVIVSITSTFFVLLFGSMAGFAIARLPIKAKQPMIILLLIISVFPPLVVITPLYMLLRDVGWLDSYQALVIPYTAFNLPFAIWILRNYFLQVPGALFEAAKIDGASVFMSYWRIFLPLTTPGLFTAAVFTFVACWTEFFMALVFNPDNTMRTIPVGIALFSGQYTVPYGTIFAGSVVSIVPIVILVVIFRRWIVSGLTQGAVKG

SEQ ID NO: 98 - DNA, 882 bp, Artificial
  Substituion in SEQ ID NO 87
ttgtctaatattcctgtccgcctttcgcgggatggtcggggaggaagcgcaatgagaaagccgttgtatcaacgcatcatcggctatgtcgtgctcattttctttctcgtcgtgatcctgctcccattctattggatgttcgtcacgtcgttcgagcccaattccgacatcagcgcttatccgccggcgtacttcccgcatcattggacgctttctcattatgaagaggccttcggccaatttcactttggacggtacatcctcaacagcgtgattgtctccatcacatcgacgttcttcgtgcttctgttcggatccatggcggggtttgcgttagcacggcttcccatcaaggccaagcagccgatgctcatccttctgctcatcatctcggtgtttccgccgctcgtcgtgatcacgcccctgtatatgttgcttcgcgacgtggggtggctcgactcctatcaggcgctcgtcattccgtatacggcgttcaacttgccgtttgccatttggattctgcggaactattttttgcaggtgccaggtgccttgtttgaagcggctaaaatcgacggtgcgtccgtgttcatgtcgtactggcgcatcttcctgccgctcaccacgccggggctctttacggcagccgtgttcacgttcgtcgcctgctggacggagttcttcatggcgctcgtgttcaaccctgacaacaccatgcgcaccattccggttggcattgcgctgttcagcgggcagtacacggttccgtacggcaccatctttgctggctccgtggtgtcgattgtccccatcgtcattctcgtggtgatcttccgccgctggatcgtgtcggggttgacgcagggcgctgtcaaaggctaa

SEQ ID NO: 99 - DNA, 882 bp, Artificial
  Substituion in SEQ ID NO 87
ttgtctaatattcctgtccgcctttcgcgggatggtcggggaggaagcgcaatgagaaagccgttgtatcaacgcatcatcggctatgtcgtgctcattttctttctcgtcgtgatcctgctcccattctattggatgttcgtcacgtcgttcgagcccaattccgacatcagcgcttatccgccggcgtacttcccgcatcattggacgctttctcattatgaagaggccttcggccaatttcactttggacggtacatcctcaacagcgtgattgtctccatcacatcgacgttcttcgtgcttctgttcggatccatggcggggtttgcgattgcacggcttcccatcaaggccaagcagccgatgctcatccttctgctcatcatctcgatttttccgccgctcgtcgtgatcacgcccctgtatatgttgcttcgcgacgtggggtggctcgactcctatcaggcgctcgtcattccgtatacggcgttcaacttgccgtttgccatttggattctgcggaactattttttgcaggtgccaggtgccttgtttgaagcggctaaaatcgacggtgcgtccgtgttcatgtcgtactggcgcatcttcctgccgctcaccacgccggggctctttacggcagccgtgttcacgttcgtcgcctgctggacggagttcttcatggcgctcgtgttcaaccctgacaacaccatgcgcaccattccggttggcattgcgctgttcagcgggcagtacacggttccgtacggcaccatctttgctggctccgtggtgtcgattgtccccatcgtcattctcgtggtgatcttccgccgctggatcgtgtcggggttgacgcagggcgctgtcaaaggctaa

SEQ ID NO: 100 - DNA, 882 bp, Artificial
  Substituion in SEQ ID NO 87
ttgtctaatattcctgtccgcctttcgcgggatggtcggggaggaagcgcaatgagaaagccgttgtatcaacgcatcatcggctatgtcgtgctcattttctttctcgtcgtgatcctgctcccattctattggatgttcgtcacgtcgttcgagcccaattccgacatcagcgcttatccgccggcgtacttcccgcatcattggacgctttctcattatgaagaggccttcggccaatttcactttggacggtacatcctcaacagcgtgattgtctccatcacatcgacgttcttcgtgcttctgttcggatccatggcggggtttgcgattgcacggcttcccatcaaggccaagcagccgatgctcatccttctgctcatcatctcggtgtttccgccgctcgtcgtgatcacgcccctgtatatgttgcttcgcgacgtggggtggctcgactcctatcaggcgctcgtcattccgtatacggcgttcaacttgccgtttgccatttggattctgcggaactattttttgcaggtgccaggtgccttgtttgaagcggctcgtatcgacggtgcgtccgtgttcatgtcgtactggcgcatcttcctgccgctcaccacgccggggctctttacggcagccgtgttcacgttcgtcgcctgctggacggagttcttcatggcgctcgtgttcaaccctgacaacaccatgcgcaccattccggttggcattgcgctgttcagcgggcagtacacggttccgtacggcaccatctttgctggctccgtggtgtcgattgtccccatcgtcattctcgtggtgatcttccgccgctggatcgtgtcggggttgacgcagggcgctgtcaaaggctaa

SEQ ID NO: 101 - DNA, 882 bp, Artificial
  Substituion in SEQ ID NO 87
ttgtctaatattcctgtccgcctttcgcgggatggtcggggaggaagcgcaatgagaaagccgttgtatcaacgcatcatcggctatgtcgtgctcattttctttctcgtcgtgatcctgctcccattctattggatgttcgtcacgtcgttcgagcccaattccgacatcagcgcttatccgccggcgtacttcccgcatcattggacgctttctcattatgaagaggccttcggccaatttcactttggacggtacatcctcaacagcgtgattgtctccatcacatcgacgttcttcgtgcttctgttcggatccatggcggggtttgcgattgcacggcttcccatcaaggccaagcagccgatgctcatccttctgctcatcatctcggtgtttccgccgctcgtcgtgatcacgcccctgtatatgttgcttcgcgacgtggggtggctcgactcctatcaggcgctcgtcattccgtatacggcgttcaacttgccgtttgccatttggattctgcggaactattttttgcaggtgccaggtgccttgtttgaagcggctaaaatcgacggtgcgtccgtgttcatgtcgtactggcgcatcttcattccgctcaccacgccggggctctttacggcagccgtgttcacgttcgtcgcctgctggacggagttcttcatggcgctcgtgttcaaccctgacaacaccatgcgcaccattccggttggcattgcgctgttcagcgggcagtacacggttccgtacggcaccatctttgctggctccgtggtgtcgattgtccccatcgtcattctcgtggtgatcttccgccgctggatcgtgtcggggttgacgcagggcgctgtcaaaggctaa

SEQ ID NO: 102 - DNA, 882 bp, Artificial
  Substituion in SEQ ID NO 87
ttgtctaatattcctgtccgcctttcgcgggatggtcggggaggaagcgcaatgagaaagccgttgtatcaacgcatcatcggctatgtcgtgctcattttctttctcgtcgtgatcctgctcccattctattggatgttcgtcacgtcgttcgagcccaattccgacatcagcgcttatccgccggcgtacttcccgcatcattggacgctttctcattatgaagaggccttcggccaatttcactttggacggtacatcctcaacagcgtgattgtctccatcacatcgacgttcttcgtgcttctgttcggatccatggcggggtttgcgattgcacggcttcccatcaaggccaagcagccgatgattatccttctgctcatcatctcggtgtttccgccgctcgtcgtgatcacgcccctgtatatgttgcttcgcgacgtggggtggctcgactcctatcaggcgctcgtcattccgtatacggcgttcaacttgccgtttgccatttggattctgcggaactattttttgcaggtgccaggtgccttgtttgaagcggctaaaatcgacggtgcgtccgtgttcatgtcgtactggcgcatcttcctgccgctcaccacgccggggctctttacggcagccgtgttcacgttcgtcgcctgctggacggagttcttcatggcgctcgtgttcaaccctgacaacaccatgcgcaccattccggttggcattgcgctgttcagcgggcagtacacggttccgtacggcaccatctttgctggctccgtggtgtcgattgtccccatcgtcattctcgtggtgatcttccgccgctggatcgtgtcggggttgacgcagggcgctgtcaaaggctaa

SEQ ID NO: 103 - protein, 540 aa, Alicyclobacillus acidocaldarius
MHRVHALFHANAVDYIIILVYFAFVLGVGFVLRNRVRTGEDFFLSGRSIPAWITGLAFLSANLGALEILGMTASGAEYGMLTTHFYWIGAIPAMLFLGLYMMPFYYVSKVRSVPEFLKLRYNEATRALNAIAFAVMTVLTSGISLYSMALIFQILIGWSFDTSILVSALVVLIYVALGGLTSSIFNEVVQFFLIWAGLLPIPLIGLHNLGGWQGMMSRLPAGFGHLWANLGSPSHNPMGIGWLGVVLGLGFVLSFGYWTTDFLVVQRTLAAKDLRAAQLTPIYAAFFKMIVPILVIIPGLIALAIFPKIGHSPNMSYNLALPLLIAKYYPPGMLGLGLTAMLASFMSGMAGNVTAFTTVWTYDIYQAYIKKDAPDKHYVNMGRWAVVVGVIISIGTAYFAAGFPSVMDYMQTLFSFFNAPLFATFLLGMFWKKATPWGGFWGLLAGIAGAFAMYFFLPAHMFSSPDAGNFWRAWWAWVITVVVTVLVSLVTQGKRPEELEGLVYGLSKRPDYSGYPWYKRPGYLAAIVFVILVGLNIAFW

SEQ ID NO: 104 - DNA, 1623 bp, Alicyclobacillus acidocaldarius
gtgcatcgggtgcacgcgctatttcatgcgaacgccgtggactacatcatcatcctggtctacttcgctttcgtcctcggcgtcggattcgtccttcgtaaccgcgttcgcactggagaggatttctttttgtccggccgatccatcccggcctggatcacgggcttggcgtttctatccgccaacctcggggcgctcgagattctcggcatgaccgcgagcggcgccgaatacggcatgctcacgactcacttttactggatcggtgcgatcccggccatgttgtttctcggcctgtacatgatgccgttttactatgtgtcgaaggtgcgctcggtgccggagttcttgaaactgcggtacaacgaagcgacccgcgcgctcaatgccatcgcgttcgccgtgatgaccgtcctgacgtcgggcatcagcttgtattccatggcgctgatctttcagatcttgattggttggtcgtttgacaccagcattctcgtgtctgcgctcgtggttttgatctacgttgcgctcggaggtctgacctcgtcgatctttaacgaggtcgtgcagttcttcttgatttgggctggtttgctgcccatcccgctcatcggcctgcacaatctgggcggatggcagggcatgatgtcccggctgcccgcggggttcggacatctttgggcgaacctgggttccccgtctcacaacccgatgggaattggctggcttggcgtggtgctcgggctcggttttgtgctctcgttcgggtactggacgacggacttcttggtcgttcagcgcaccctcgcggcgaaggatctgcgcgcggcccaattgacgccgatttacgcagcgttctttaagatgattgttccgattctggtgatcatcccggggctgattgcgctcgccatctttccgaagatcggccattcgccgaacatgagctacaacctggcgctgcccctgctcatcgccaaatactatccgcctggcatgctcgggcttggactgacggccatgctcgcgagcttcatgagcggtatggcgggcaatgtcaccgcgtttacgacggtttggacgtatgatatctatcaggcgtacatcaagaaggacgcaccggacaagcactatgtgaacatggggcgctgggcggtcgtggtcggcgtcatcatcagcatcggcaccgcctacttcgcggccggtttcccgagcgtcatggattacatgcagacgctgttctcgttcttcaacgcgccgctgttcgccacgttcttgttggggatgttctggaaaaaggccacgccttggggcggtttctggggcctgctcgcgggtatcgccggcgcgttcgccatgtacttcttcctgcccgcgcatatgttctcgagcccggatgcaggtaacttctggcgcgcatggtgggcctgggtgatcacggtcgtcgtgaccgtcttggtaagccttgtgacgcagggcaagcggcccgaagagctggaaggcctcgtgtacggcctcagcaagcggcccgactacagcggttatccgtggtacaagcgcccgggttacctggcggccatcgtgttcgtgatcctggtgggcctgaatatcgcgttctggtga

SEQ ID NO: 105 - protein, 533 aa, Rubrobacter xylanophilus DSM 9941
VDYLIIGIYFLFVLGIGALLRDKMRTSEDYFLSGRSLPSWVTGLAFLGANLGALEILGMGAGAAQYGLMQAHFYWIGAIPAMVFVALFMIPFYYGSRVHSVPGYLKLRYNEATRGFNAVLFAIFMILLSGINMYAMAIVFKLLLGWSLTASILLSAAITMAYILLGGLSSSIYNEVLQFFLITLGLVPLVVFALIDVGGWAGLQEAVDREGYFHLWAHTGTTDNPMAVRWFGIVLGLGFVLSFGYWCTDFLVVQRALAAEDAAAAQRTPLIAAFPKLLYGILAIFPGLVALTIVPNLGQGGGGLANSYNMAIPYAMAHYFPSGMLGLGLTALLAAFMSGMAGNVTAFNTVWTYDIYRSYIRRDAPDRHYLNMGRIATVAGVVLSVGTAYIVLGFASIMDYVQLLHGLFLAPLFGTFLLGMFWKRTTPWGGFAGLVSGTAAGLVLYGLELLGTIQYGAPMAGNFWRAWWAWLVCFVVTIAVSLVTRPKEERELRGLVYGLTEKKEGVEQAWYKKPGVLAAAVLLITLVLNVIFF

SEQ ID NO: 106 - protein, 555 aa, Acidobacteria bacterium Ellin345
LVNLSSTDLVIIVFYFALVLAIGWQLKGQAKTGEDFFMAGREMTAWIAGLSFLSANLGSLELMGWAGAAYQYGILAAHWYWIGAIPAMIFLGLVMMPFYYISKTHSVPGYLKLRFGEPSRALSAVSFAFMTVLMSGINMYSMALVMKVVLGWDINVSIIVSSITVAIYVTLGGLRSAIFNEVLQFILIWAGALLIPIMGLIEAGGWTNLKAQITRNASAEYTHLWSTLGKFSDNPMGINWIGIVFGLGAIISMGYWTTDFLVVQRVLAAKDMRSAKMAPIIGAAFKMLVPFIVILPGLLALAVLPMKLVGESQAIATHGHSYNEVLPLMLARYCGPGLLGLGITALIAGFMSGMAGNVSAFTTVWTYDIYRAMIKKDASDAHYVNMGRASTIGGVIISILTAYFVMKFASIMDYVQALFSFFIAPLFATVVLGMLWKRATNAGGFWGLLAGTVSSVGMYAWVKLDPSALRYVAMSPDAQAMAENMYRALWSCLICALVTVVVSYATKPRPDAELVGLVKSVTPIPSEGDVPMYMRPAFWACVVAVGFIILQIIFW

SEQ ID NO: 107 - protein, 556 aa, Solibacter usitatus Ellin6076
LMTLSTVDLAIIVLYFAAVLGIGFYLKRFTKTGEDFFLAGREMTAWIAGLSFLAANLGSLELMGWAASAYQYGILATHWYWIGAIPAMLFLGIVMIPFYYISKTHSVPGYLKLRFGEPARALSAISFGLMTVFMSGINMYSMALVMKVVLGWDIHVSIWISSITVMLYVGLGGLLSAIFNEVLQFVLIWLGAMLISIIGLIEAGGWDGMVAKIHANFPQGDYTHAWRTLGSFNDNPMGINWVGIVFGLGAVISMGYWTTDFLVVQRVISAKDLRAAKLAPIIGAAFKMCVPFIVILPGLLGLAVLPEHLLPESQALATGGHSYNEVLPIMLARYCGPGLLGLGITALIAGFMSGMAGNVSAFATVWTYDVYRAMFNKNATDSHYVSVGRWCTFWGVLASIGTAYMVMSFASIMDYVQALFSFFIAPLFGTVILGMLWKRASPAGGFWGLAAGTASSIGMWAWVKIDHTAIQYVAMSPNAKDMAENMFRALWSWLVCVIVTVVVSLMTKPKPEKELVNLVYGCTDIPSEGHLPVWQRPAFWACVVGAVFIALNIIFW

SEQ ID NO: 108 - protein, 553 aa, Solibacter usitatus Ellin6076
AVDYAILALYFAFVLGIGWRLRKKISTSGDFLTSGHSVPVWITSLAFLAANLGAQELVGMSGNGAKYGIMTAHFYWVGAVPAMIFVGIFMMPFYYGSRARSVPEYLKLRFDEKTRALNALTFAGMTIFSSGISMYALGLLLRLVLGWDFTTSVLCSAAIVLAYTFLGGLTSAIYNEVLQFFLIVMGFSPLAIMAVMKAGGWSGMSARLAQMTLPGGINGSVMTHSWKYMAHTSENPMGIEIFGLVAGLGFVMSFGYWCTDFLVIQRAMAANSMSASRRTPVIAALPKMMMPFIVIVPGIAALALSQMGVGYDLPMKNGGPDYDQVLTTLMGKFYPAGMLGVGLTGLMASFMSGMAGNVTAFNTVFTYDLYQTYIKPGQPDHHYLTVGRITTVVGVALSICTAYLAQQYNSINDLLQLVFSFVNAPLFGTFLLGMFWKRTTGHGAFFGLLSGTAAAALTQGLTVAEGKGGWMANLHEFPSSMAQNFWIAITAWTVCFAITIAVSMVTTPRPEKELHGLVYGLTELKHDEGVSWYLRPVPLAIAIGALALFLNFW

SEQ ID NO: 109 - protein, 554 aa, Saccharopolyspora erythraea NRRL 2338
QVELRLDASAVDYVLLAIYFVFVLGIGYLARRSVSTSLDFFLSGRALPAWVTGLAFIAANLGAIEIIGMSANGAEYGMPTMHYFWIGAVPAMLFLGIVMMPFYYGSKVRSVPEFMLRRFGKPAHLVNGISFAVAQVLIAGVNLYLLASIVNVLLGWPLWVSVLIAAAIVLSYTALGGLSAAIYNEVLQFFVIVAALLPLTIVGLTKVGGWEGLVAKVSASPGGAEQLTAWPGNELTGFTNSFLSVVGLVFGLGFVLSFGYWTTNFVEVQRAMASKSMSAAQRTPIIGAFPKMFIPFLVIIPGMIAAVLVPDLSAYKATGAGAVDYNDALLLLMRDLLPNGLLGIALAGLLASFMAGMAANLSSFNTVFTYDLWQAYIVKDKPDHYYLNMGRWVTVGATVVAVGTAFIAAGYENLMDYLQQLFSFFNAPLFATFILGMFWKRMTPTAGWLGLVLGTLAAVTVFGLSEGGVLDLPGQGASFVGAGAAFVVDIVVSVLVSMATRPKADTELVGLVYSLTPKESRTASTSGEDAGWYRRPGLLAGIVLVITVLLNIIF

SEQ ID NO: 110 - protein, 540 aa, Artificial
  Substituion in SEQ ID NO 103
MHRVHALFHANAVDYIIILVYFAFVLGVGFVLRNRVRTGEDFFLSGRSIPAWITGLAFLSANLGALEILGMTASGAEYGMLTTHFYWIGALPAMLFLGLYMMPFYYVSKVRSVPEFLKLRYNEATRALNAIAFAVMTVLTSGISLYSMALIFQILIGWSFDTSILVSALVVLIYVALGGLTSSIFNEVVQFFLIWAGLLPIPLIGLHNLGGWQGMMSRLPAGFGHLWANLGSPSHNPMGIGWLGVVLGLGFVLSFGYWTTDFLVVQRTLAAKDLRAAQLTPIYAAFFKMIVPILVIIPGLIALAIFPKIGHSPNMSYNLALPLLIAKYYPPGMLGLGLTAMLASFMSGMAGNVTAFTTVWTYDIYQAYIKKDAPDKHYVNMGRWAVVVGVIISIGTAYFAAGFPSVMDYMQTLFSFFNAPLFATFLLGMFWKKATPWGGFWGLLAGIAGAFAMYFFLPAHMFSSPDAGNFWRAWWAWVITVVVTVLVSLVTQGKRPEELEGLVYGLSKRPDYSGYPWYKRPGYLAAIVFVILVGLNIAFW

SEQ ID NO: 111 - protein, 540 aa, Artificial
  Substituion in SEQ ID NO 103
MHRVHAIFHANAVDYIIILVYFAFVLGVGFVLRNRVRTGEDFFLSGRSIPAWITGLAFLSANLGALEILGMTASGAEYGMLTTHFYWIGAIPAMLFLGLYMMPFYYVSKVRSVPEFLKLRYNEATRALNAIAFAVMTVLTSGISLYSMALIFQILIGWSFDTSILVSALVVLIYVALGGLTSSIFNEVVQFFLIWAGLLPIPLIGLHNLGGWQGMMSRLPAGFGHLWANLGSPSHNPMGIGWLGVVLGLGFVLSFGYWTTDFLVVQRTLAAKDLRAAQLTPIYAAFFKMIVPILVIIPGLIALAIFPKIGHSPNMSYNLALPLLIAKYYPPGMLGLGLTAMLASFMSGMAGNVTAFTTVWTYDIYQAYIKKDAPDKHYVNMGRWAVVVGVIISIGTAYFAAGFPSVMDYMQTLFSFFNAPLFATFLLGMFWKKATPWGGFWGLLAGIAGAFAMYFFLPAHMFSSPDAGNFWRAWWAWVITVVVTVLVSLVTQGKRPEELEGLVYGLSKRPDYSGYPWYKRPGYLAAIVFVILVGLNIAFW

SEQ ID NO: 112 - protein, 540 aa, Artificial
  Substituion in SEQ ID NO 103
MHRVHALFHANAVDYIIILVYFAFVLGVGFVLRNRVRTGEDFFLSGRSIPAWITGLAFLSANLGALEILGMTASGAEYGMLTTHFYWIGAIPAMLFLGLYMMPFYYVSKVRSVPEFLKLRYQEATRALNAIAFAVMTVLTSGISLYSMALIFQILIGWSFDTSILVSALVVLIYVALGGLTSSIFNEVVQFFLIWAGLLPIPLIGLHNLGGWQGMMSRLPAGFGHLWANLGSPSHNPMGIGWLGVVLGLGFVLSFGYWTTDFLVVQRTLAAKDLRAAQLTPIYAAFFKMIVPILVIIPGLIALAIFPKIGHSPNMSYNLALPLLIAKYYPPGMLGLGLTAMLASFMSGMAGNVTAFTTVWTYDIYQAYIKKDAPDKHYVNMGRWAVVVGVIISIGTAYFAAGFPSVMDYMQTLFSFFNAPLFATFLLGMFWKKATPWGGFWGLLAGIAGAFAMYFFLPAHMFSSPDAGNFWRAWWAWVITVVVTVLVSLVTQGKRPEELEGLVYGLSKRPDYSGYPWYKRPGYLAAIVFVILVGLNIAFW

SEQ ID NO: 113 - protein, 540 aa, Artificial
  Substituion in SEQ ID NO 103
MHRVHALFHANAVDYIIILVYFAFVLGVGFVLRNRVRTGEDFFLSGRSIPAWITGLAFLSANLGALEILGMTASGAEYGMLTTHFYWIGAIPAMLFLGLYMMPFYYVSKVRSVPEFLKLRYNEATRALNAIAFAVMTVLTSGISLYSMALIFQILIGWSFDTSILVSALVVLIYVALGGLTSSIFNEVVQFFLIWAGLLPIPLIGLHNLGGWQGMMSRLPAGFGHLWANLGSPSHNPMGIGWLGVVLGLGFVLSFGYWTTDFLVVQRTLAAKDLRAAQLTPIYAAFFKMIVPILVIIPGLIALAIFPKIGHSPNMSYNLALPLLIAKYYPPGMLGLGLTAMLASFMSGMAGNVTAFTTVWTYDIYQAYIKKDAPDKHYVNMGRWAVVVGVIISIGTAYFAAGFPSVMDYMQTLFSFFNAPLFATFLLGMFWKKATPWGGFWGLLAGIAGAFAMYFFLPAHMFSSPDAGNFWRAWWAWVITVVVTVLVSLVTQGKRPEELEGLVYGLSKKPDYSGYPWYKRPGYLAAIVFVILVGLNIAFW

SEQ ID NO: 114 - protein, 540 aa, Artificial
  Substituion in SEQ ID NO 103
MHRVHALFHANAVDYIIILVYFAFVLGVGFVLRNRVRTGEDFFLSGRSIPAWITGLAFLSANLGALEILGMTASGAEYGMLTTHFYWIGAIPAMLFLGLYMMPFYYVSKVRSVPEFLKLRYNEATRALNAIAFAVMTVLTSGISLYSMALIFQILIGWSFDTSILVSALVVLIYVALGGLTSSIFNEVVQFFLIWAGLLPIPLIGLHNLGGWQGMMSRLPAGFGHLWANLGSPSHNPMGIGWLGVVLGLGFVLSFGYWTTDFLVVQRTLAAKDLRAAQLTPIYAAFFKMIVPILVIIPGLIALAIFPKIGHSPNMSYNLALPLLIAKYYPPGMLGLGLTAMLASFMSGMAGNVTAFTTVWTYDIYQAYIKKDAPDKHYVNMGRWAVVVGVIISIGTAYFAAGFPSVMDYMQTLFSFFNAPLFATFLLGMFWKKATPWGGFWGLLAGIAGAFAMYFFLPAHMFSSPDAGNFWRAWWAWIITVVVTVLVSLVTQGKRPEELEGLVYGLSKRPDYSGYPWYKRPGYLAAIVFVILVGLNIAFW

SEQ ID NO: 115 - DNA, 1623 bp, Artificial
  Substituion in SEQ ID NO 104
gtgcatcgggtgcacgcgctatttcatgcgaacgccgtggactacatcatcatcctggtctacttcgctttcgtcctcggcgtcggattcgtccttcgtaaccgcgttcgcactggagaggatttctttttgtccggccgatccatcccggcctggatcacgggcttggcgtttctatccgccaacctcggggcgctcgagattctcggcatgaccgcgagcggcgccgaatacggcatgctcacgactcacttttactggatcggtgcgttaccggccatgttgtttctcggcctgtacatgatgccgttttactatgtgtcgaaggtgcgctcggtgccggagttcttgaaactgcggtacaacgaagcgacccgcgcgctcaatgccatcgcgttcgccgtgatgaccgtcctgacgtcgggcatcagcttgtattccatggcgctgatctttcagatcttgattggttggtcgtttgacaccagcattctcgtgtctgcgctcgtggttttgatctacgttgcgctcggaggtctgacctcgtcgatctttaacgaggtcgtgcagttcttcttgatttgggctggtttgctgcccatcccgctcatcggcctgcacaatctgggcggatggcagggcatgatgtcccggctgcccgcggggttcggacatctttgggcgaacctgggttccccgtctcacaacccgatgggaattggctggcttggcgtggtgctcgggctcggttttgtgctctcgttcgggtactggacgacggacttcttggtcgttcagcgcaccctcgcggcgaaggatctgcgcgcggcccaattgacgccgatttacgcagcgttctttaagatgattgttccgattctggtgatcatcccggggctgattgcgctcgccatctttccgaagatcggccattcgccgaacatgagctacaacctggcgctgcccctgctcatcgccaaatactatccgcctggcatgctcgggcttggactgacggccatgctcgcgagcttcatgagcggtatggcgggcaatgtcaccgcgtttacgacggtttggacgtatgatatctatcaggcgtacatcaagaaggacgcaccggacaagcactatgtgaacatggggcgctgggcggtcgtggtcggcgtcatcatcagcatcggcaccgcctacttcgcggccggtttcccgagcgtcatggattacatgcagacgctgttctcgttcttcaacgcgccgctgttcgccacgttcttgttggggatgttctggaaaaaggccacgccttggggcggtttctggggcctgctcgcgggtatcgccggcgcgttcgccatgtacttcttcctgcccgcgcatatgttctcgagcccggatgcaggtaacttctggcgcgcatggtgggcctgggtgatcacggtcgtcgtgaccgtcttggtaagccttgtgacgcagggcaagcggcccgaagagctggaaggcctcgtgtacggcctcagcaagcggcccgactacagcggttatccgtggtacaagcgcccgggttacctggcggccatcgtgttcgtgatcctggtgggcctgaatatcgcgttctggtga

SEQ ID NO: 116 - DNA, 1623 bp, Artificial
  Substituion in SEQ ID NO 104
gtgcatcgggtgcacgcgatttttcatgcgaacgccgtggactacatcatcatcctggtctacttcgctttcgtcctcggcgtcggattcgtccttcgtaaccgcgttcgcactggagaggatttctttttgtccggccgatccatcccggcctggatcacgggcttggcgtttctatccgccaacctcggggcgctcgagattctcggcatgaccgcgagcggcgccgaatacggcatgctcacgactcacttttactggatcggtgcgatcccggccatgttgtttctcggcctgtacatgatgccgttttactatgtgtcgaaggtgcgctcggtgccggagttcttgaaactgcggtacaacgaagcgacccgcgcgctcaatgccatcgcgttcgccgtgatgaccgtcctgacgtcgggcatcagcttgtattccatggcgctgatctttcagatcttgattggttggtcgtttgacaccagcattctcgtgtctgcgctcgtggttttgatctacgttgcgctcggaggtctgacctcgtcgatctttaacgaggtcgtgcagttcttcttgatttgggctggtttgctgcccatcccgctcatcggcctgcacaatctgggcggatggcagggcatgatgtcccggctgcccgcggggttcggacatctttgggcgaacctgggttccccgtctcacaacccgatgggaattggctggcttggcgtggtgctcgggctcggttttgtgctctcgttcgggtactggacgacggacttcttggtcgttcagcgcaccctcgcggcgaaggatctgcgcgcggcccaattgacgccgatttacgcagcgttctttaagatgattgttccgattctggtgatcatcccggggctgattgcgctcgccatctttccgaagatcggccattcgccgaacatgagctacaacctggcgctgcccctgctcatcgccaaatactatccgcctggcatgctcgggcttggactgacggccatgctcgcgagcttcatgagcggtatggcgggcaatgtcaccgcgtttacgacggtttggacgtatgatatctatcaggcgtacatcaagaaggacgcaccggacaagcactatgtgaacatggggcgctgggcggtcgtggtcggcgtcatcatcagcatcggcaccgcctacttcgcggccggtttcccgagcgtcatggattacatgcagacgctgttctcgttcttcaacgcgccgctgttcgccacgttcttgttggggatgttctggaaaaaggccacgccttggggcggtttctggggcctgctcgcgggtatcgccggcgcgttcgccatgtacttcttcctgcccgcgcatatgttctcgagcccggatgcaggtaacttctggcgcgcatggtgggcctgggtgatcacggtcgtcgtgaccgtcttggtaagccttgtgacgcagggcaagcggcccgaagagctggaaggcctcgtgtacggcctcagcaagcggcccgactacagcggttatccgtggtacaagcgcccgggttacctggcggccatcgtgttcgtgatcctggtgggcctgaatatcgcgttctggtga

SEQ ID NO: 117 - DNA, 1623 bp, Artificial
  Substituion in SEQ ID NO 104
gtgcatcgggtgcacgcgctatttcatgcgaacgccgtggactacatcatcatcctggtctacttcgctttcgtcctcggcgtcggattcgtccttcgtaaccgcgttcgcactggagaggatttctttttgtccggccgatccatcccggcctggatcacgggcttggcgtttctatccgccaacctcggggcgctcgagattctcggcatgaccgcgagcggcgccgaatacggcatgctcacgactcacttttactggatcggtgcgatcccggccatgttgtttctcggcctgtacatgatgccgttttactatgtgtcgaaggtgcgctcggtgccggagttcttgaaactgcggtaccaagaagcgacccgcgcgctcaatgccatcgcgttcgccgtgatgaccgtcctgacgtcgggcatcagcttgtattccatggcgctgatctttcagatcttgattggttggtcgtttgacaccagcattctcgtgtctgcgctcgtggttttgatctacgttgcgctcggaggtctgacctcgtcgatctttaacgaggtcgtgcagttcttcttgatttgggctggtttgctgcccatcccgctcatcggcctgcacaatctgggcggatggcagggcatgatgtcccggctgcccgcggggttcggacatctttgggcgaacctgggttccccgtctcacaacccgatgggaattggctggcttggcgtggtgctcgggctcggttttgtgctctcgttcgggtactggacgacggacttcttggtcgttcagcgcaccctcgcggcgaaggatctgcgcgcggcccaattgacgccgatttacgcagcgttctttaagatgattgttccgattctggtgatcatcccggggctgattgcgctcgccatctttccgaagatcggccattcgccgaacatgagctacaacctggcgctgcccctgctcatcgccaaatactatccgcctggcatgctcgggcttggactgacggccatgctcgcgagcttcatgagcggtatggcgggcaatgtcaccgcgtttacgacggtttggacgtatgatatctatcaggcgtacatcaagaaggacgcaccggacaagcactatgtgaacatggggcgctgggcggtcgtggtcggcgtcatcatcagcatcggcaccgcctacttcgcggccggtttcccgagcgtcatggattacatgcagacgctgttctcgttcttcaacgcgccgctgttcgccacgttcttgttggggatgttctggaaaaaggccacgccttggggcggtttctggggcctgctcgcgggtatcgccggcgcgttcgccatgtacttcttcctgcccgcgcatatgttctcgagcccggatgcaggtaacttctggcgcgcatggtgggcctgggtgatcacggtcgtcgtgaccgtcttggtaagccttgtgacgcagggcaagcggcccgaagagctggaaggcctcgtgtacggcctcagcaagcggcccgactacagcggttatccgtggtacaagcgcccgggttacctggcggccatcgtgttcgtgatcctggtgggcctgaatatcgcgttctggtga

SEQ ID NO: 118 - DNA, 1623 bp, Artificial
  Substituion in SEQ ID NO 104
gtgcatcgggtgcacgcgctatttcatgcgaacgccgtggactacatcatcatcctggtctacttcgctttcgtcctcggcgtcggattcgtccttcgtaaccgcgttcgcactggagaggatttctttttgtccggccgatccatcccggcctggatcacgggcttggcgtttctatccgccaacctcggggcgctcgagattctcggcatgaccgcgagcggcgccgaatacggcatgctcacgactcacttttactggatcggtgcgatcccggccatgttgtttctcggcctgtacatgatgccgttttactatgtgtcgaaggtgcgctcggtgccggagttcttgaaactgcggtacaacgaagcgacccgcgcgctcaatgccatcgcgttcgccgtgatgaccgtcctgacgtcgggcatcagcttgtattccatggcgctgatctttcagatcttgattggttggtcgtttgacaccagcattctcgtgtctgcgctcgtggttttgatctacgttgcgctcggaggtctgacctcgtcgatctttaacgaggtcgtgcagttcttcttgatttgggctggtttgctgcccatcccgctcatcggcctgcacaatctgggcggatggcagggcatgatgtcccggctgcccgcggggttcggacatctttgggcgaacctgggttccccgtctcacaacccgatgggaattggctggcttggcgtggtgctcgggctcggttttgtgctctcgttcgggtactggacgacggacttcttggtcgttcagcgcaccctcgcggcgaaggatctgcgcgcggcccaattgacgccgatttacgcagcgttctttaagatgattgttccgattctggtgatcatcccggggctgattgcgctcgccatctttccgaagatcggccattcgccgaacatgagctacaacctggcgctgcccctgctcatcgccaaatactatccgcctggcatgctcgggcttggactgacggccatgctcgcgagcttcatgagcggtatggcgggcaatgtcaccgcgtttacgacggtttggacgtatgatatctatcaggcgtacatcaagaaggacgcaccggacaagcactatgtgaacatggggcgctgggcggtcgtggtcggcgtcatcatcagcatcggcaccgcctacttcgcggccggtttcccgagcgtcatggattacatgcagacgctgttctcgttcttcaacgcgccgctgttcgccacgttcttgttggggatgttctggaaaaaggccacgccttggggcggtttctggggcctgctcgcgggtatcgccggcgcgttcgccatgtacttcttcctgcccgcgcatatgttctcgagcccggatgcaggtaacttctggcgcgcatggtgggcctgggtgatcacggtcgtcgtgaccgtcttggtaagccttgtgacgcagggcaagcggcccgaagagctggaaggcctcgtgtacggcctcagcaagaaacccgactacagcggttatccgtggtacaagcgcccgggttacctggcggccatcgtgttcgtgatcctggtgggcctgaatatcgcgttctggtga

SEQ ID NO: 119 - DNA, 1623 bp, Artificial
  Substituion in SEQ ID NO 104
gtgcatcgggtgcacgcgctatttcatgcgaacgccgtggactacatcatcatcctggtctacttcgctttcgtcctcggcgtcggattcgtccttcgtaaccgcgttcgcactggagaggatttctttttgtccggccgatccatcccggcctggatcacgggcttggcgtttctatccgccaacctcggggcgctcgagattctcggcatgaccgcgagcggcgccgaatacggcatgctcacgactcacttttactggatcggtgcgatcccggccatgttgtttctcggcctgtacatgatgccgttttactatgtgtcgaaggtgcgctcggtgccggagttcttgaaactgcggtacaacgaagcgacccgcgcgctcaatgccatcgcgttcgccgtgatgaccgtcctgacgtcgggcatcagcttgtattccatggcgctgatctttcagatcttgattggttggtcgtttgacaccagcattctcgtgtctgcgctcgtggttttgatctacgttgcgctcggaggtctgacctcgtcgatctttaacgaggtcgtgcagttcttcttgatttgggctggtttgctgcccatcccgctcatcggcctgcacaatctgggcggatggcagggcatgatgtcccggctgcccgcggggttcggacatctttgggcgaacctgggttccccgtctcacaacccgatgggaattggctggcttggcgtggtgctcgggctcggttttgtgctctcgttcgggtactggacgacggacttcttggtcgttcagcgcaccctcgcggcgaaggatctgcgcgcggcccaattgacgccgatttacgcagcgttctttaagatgattgttccgattctggtgatcatcccggggctgattgcgctcgccatctttccgaagatcggccattcgccgaacatgagctacaacctggcgctgcccctgctcatcgccaaatactatccgcctggcatgctcgggcttggactgacggccatgctcgcgagcttcatgagcggtatggcgggcaatgtcaccgcgtttacgacggtttggacgtatgatatctatcaggcgtacatcaagaaggacgcaccggacaagcactatgtgaacatggggcgctgggcggtcgtggtcggcgtcatcatcagcatcggcaccgcctacttcgcggccggtttcccgagcgtcatggattacatgcagacgctgttctcgttcttcaacgcgccgctgttcgccacgttcttgttggggatgttctggaaaaaggccacgccttggggcggtttctggggcctgctcgcgggtatcgccggcgcgttcgccatgtacttcttcctgcccgcgcatatgttctcgagcccggatgcaggtaacttctggcgcgcatggtgggcctggattatcacggtcgtcgtgaccgtcttggtaagccttgtgacgcagggcaagcggcccgaagagctggaaggcctcgtgtacggcctcagcaagcggcccgactacagcggttatccgtggtacaagcgcccgggttacctggcggccatcgtgttcgtgatcctggtgggcctgaatatcgcgttctggtga

SEQ ID NO: 120 - protein, 384 aa, Alicyclobacillus acidocaldarius
MARVLLEHIYKTYPGQTEPTVKDFNLDIQDKEFTVFVGPSGCGKTTTLRMIAGLEDITEGNLYIGDRRVNDVPPKDRDIAMVFQNYALYPHMTVYQNMAFGLKLRKVPKAEIDRRVQEAAKILDIAHLLDRKPKALSGGQRQRVALGRAIVREPQVFLMDEPLSNLDAKLRVQMRAEIRKLHQRLQTTVIYVTHDQTEAMTMGDRIVVMRDGVIQQADTPQVVYSQPKNMFVAGFIGSPAMNFIRGEIVQDGDAFYFRAPSISLRLPEGRYGVLKASGAIGKPVVLGVRPEDLHDEEVFMTTYPDSVLQMQVEVVEHMGSEVYLHTSIGPNTIVARVNPRHVYHVGSSVKLAIDLNKIHIFDAETEESIGFAAGPAGERQEALV

SEQ ID NO: 121 - DNA, 1155 bp, Alicyclobacillus acidocaldarius
gtggctcgcgtgttgctcgagcacatttacaagacctaccccggccagacggagccgacggtgaaggacttcaacctcgacattcaggacaaggaattcaccgtgttcgtcggcccctccggctgcggcaagacgacgacgcttcgcatgatcgctggactcgaggacatcacggagggcaacctgtatatcggcgatcgccgcgtgaacgacgtgccgccgaaggatcgggacattgcgatggtgttccaaaactacgcgctctatccccatatgacggtgtatcagaacatggcgttcggcctgaagctgcgcaaggtgccgaaggccgagatcgaccggcgggtgcaggaggcggcgaagatcctcgacatcgcgcacctgctcgaccggaagccgaaggcgctctccggcggtcagcgccagcgcgtggcgttgggtcgcgccattgtgcgcgagccgcaggtgttcctgatggatgagccgctgtcgaacctggacgcgaagctgcgcgtgcagatgcgcgcggagatccgcaagctccatcagcgcttgcaaacgaccgtcatttacgttacacatgatcagacggaagccatgacgatgggcgatcgcatcgtggtcatgcgcgacggcgtcatccagcaggcggatacgccgcaggtcgtgtactcccagccgaagaacatgtttgtcgccggcttcattgggtctcctgccatgaactttattcgcggcgagatcgtgcaggacggcgatgcgttctacttccgcgcgccttccatttcgctgcgcctgccggagggccgctacggcgtgctgaaggcgtcgggggccattgggaagccggtcgtgctcggcgtgcggccggaagacctgcacgatgaggaagtgttcatgacgacgtatcccgactccgtgctgcagatgcaggtggaagtcgtggaacacatgggctcggaggtctatctgcacacgagtatcgggccgaacacgatcgtcgcgcgcgtgaacccgcgccacgtctaccacgtcggaagctcggtcaagctcgcgattgacttgaacaagatccacatcttcgacgcggagacggaggagtccatcggcttcgccgcaggtcctgcgggtgaacgtcaagaagctttggtgtga

SEQ ID NO: 122 - protein, 384 aa, Alicyclobacillus acidocaldarius; identical to SEQ ID NO: 120

SEQ ID NO: 123 - protein, 370 aa, Paenibacillus larvae subsp. larvae BRL-230010
MAGVRLNHIVKKYPGNDEATVKDFHLEIKDKEFLVLVGASGCGKSTTLRMVAGLEEITEGELYIGDRLVNDVAPKDRDIAMVFQSYALYPHMNVYQNMAFGLKLRKFKKADIDTRVREAAKLLEIEHLLDRKPKALSGGQRQRVALGRAIVREPQVFLMDEPLSNLDAKLRVQMRAVISKLVKRLETTCIYVTHDQTEAMTMGDRIVVMDKGVIQQAASPKEIYNFPVNMFVAGFIGSPSMNFVDGAISEENDELLFKAPGVNIVIPEGKAKLLREKGYTNKEVVLGIRPEDLHEEPVFLEASPNSIVSANIEVAENLGHEMNLYINGIGTSSVIARVDGRSGLKEGSTVKLALDMNKVHFFDKETTESI

SEQ ID NO: 124 - protein, 368 aa, Caldicellulosiruptor saccharolyticus DSM 8903
MASVRLKGVYKRYPGGVTAVSDFNLDIEDKEFIVLVGPSGCGKTTTLRMIAGLEEVTEGEIYIGDKLVNDVPPKDRDIAMVFQNYALYPHMTVFENMAFGLKLRKFPKDEIKRRVHEAAKILGIEHLLDRKPKALSGGQRQRVALGRAIVREPKVFLMDEPLSNLDAKLRVQMRTELSKLHKRLGTTFIYVTHDQTEAMTMGTRIVVMKDGFIQQVDTPQVLYEQPANLFVAGFIGSPQMNFIESRIEQKDKNLYVVFGNNAIKLPEGKAKKVEELGYVGKEVIMGIRPEDLHDEEIFLQTAQDAVVDAHVDVVEMLGSETLLYVVVDGLNLIARVDPRSKTKAGDKIKLAFDANRIHLFDKETEKAI

SEQ ID NO: 125 - protein, 368 aa, Thermoanaerobacter tengcongensis MB4
MAEVVLKHVYKVYPGGVTAVKDFNLEIADKEFIVLVGPSGCGKTTTLRMIAGLEEITSGELYIDGKLVNDVPPKDRDIAMVFQNYALYPHMTVYDNMAFGLKLRKVPRAEIDRKVKEAARILGLEELLNRKPKALSGGQRQRVALGRAIVRNPKVFLMDEPLSNLDAKLRVQMRTELKKLHERLQTTFIYVTHDQTEAMTMGTRIVVMKDGVIQQVDEPQVIYDYPNNLFVAGFIGSPQMNFIDARLENRDGKVYATFKGYSILVPEGILKRLKDPSYIGKEIVLGIRPEDLHDEEVFLEAYPEAVVEAKVEVTELMGAETYLYLDVNGVSLTARVDPRTRAKSGDVIKIGFDVNKLHMFDKETEMTI

SEQ ID NO: 126 - protein, 368 aa, Thermoanaerobacter pseudethanolicus ATCC 33223
MADVVLKHVYKVYPGGVTAVKDFNLEIQDKEFIVLVGPSGCGKTTTLRMIAGLEEISSGELYIDGKLVNDVPPKDRDIAMVFQNYALYPHMTVYDNMAFGLKLRKVPRAEIDRKVKEAARILGLEEYLNRKPKALSGGQRQRVALGRAIVRNPKVFLMDEPLSNLDAKLRVQMRTELAKLHDRLQTTFIYVTHDQTEAMTMGTRIVVMKDGVIQQVDKPQTIYDYPNNLFVAGFIGSPQMNFIDARLENKNGKVYATFKGFSILVPEGILKRLKDPSYVGKEIVLGIRPEDLHDEEVFLEAYPEAVVEAKVDVTELMGPETYLYLDVNGVPLTARVDPRTRAKAGDVIKIGFDINKLHMFDKETEMSI

SEQ ID NO: 127 - protein, 384 aa, Artificial
  Substituion in SEQ ID NO 120
MARVLLDHIYKTYPGQTEPTVKDFNLDIQDKEFTVFVGPSGCGKTTTLRMIAGLEDITEGNLYIGDRRVNDVPPKDRDIAMVFQNYALYPHMTVYQNMAFGLKLRKVPKAEIDRRVQEAAKILDIAHLLDRKPKALSGGQRQRVALGRAIVREPQVFLMDEPLSNLDAKLRVQMRAEIRKLHQRLQTTVIYVTHDQTEAMTMGDRIVVMRDGVIQQADTPQVVYSQPKNMFVAGFIGSPAMNFIRGEIVQDGDAFYFRAPSISLRLPEGRYGVLKASGAIGKPVVLGVRPEDLHDEEVFMTTYPDSVLQMQVEVVEHMGSEVYLHTSIGPNTIVARVNPRHVYHVGSSVKLAIDLNKIHIFDAETEESIGFAAGPAGERQEALV

SEQ ID NO: 128 - protein, 384 aa, Artificial
  Substituion in SEQ ID NO 120
MARVLLEHIYKTYPGQTEPTVKDFNLDIQDKEFTVFVGPSGCGKTTTLRMIAGLEDITEGNLYIGDRRVNDVPPKDRDIAMVFQNYALYPHMTVYQNMAFGLKLRKVPKAEIDRRVQEAAKILDIAHLLDRKPKALSGGQRQRVALGRAIVREPQVFLMDEPLSNLDAKLRVQMRADIRKLHQRLQTTVIYVTHDQTEAMTMGDRIVVMRDGVIQQADTPQVVYSQPKNMFVAGFIGSPAMNFIRGEIVQDGDAFYFRAPSISLRLPEGRYGVLKASGAIGKPVVLGVRPEDLHDEEVFMTTYPDSVLQMQVEVVEHMGSEVYLHTSIGPNTIVARVNPRHVYHVGSSVKLAIDLNKIHIFDAETEESIGFAAGPAGERQEALV

SEQ ID NO: 129 - protein, 384 aa, Artificial
  Substituion in SEQ ID NO 120
MARVLLEHIYKTYPGQTEPTVKDFNLDIQDKEFTVFVGPSGCGKTTTLRMIAGLEDITEGQLYIGDRRVNDVPPKDRDIAMVFQNYALYPHMTVYQNMAFGLKLRKVPKAEIDRRVQEAAKILDIAHLLDRKPKALSGGQRQRVALGRAIVREPQVFLMDEPLSNLDAKLRVQMRAEIRKLHQRLQTTVIYVTHDQTEAMTMGDRIVVMRDGVIQQADTPQVVYSQPKNMFVAGFIGSPAMNFIRGEIVQDGDAFYFRAPSISLRLPEGRYGVLKASGAIGKPVVLGVRPEDLHDEEVFMTTYPDSVLQMQVEVVEHMGSEVYLHTSIGPNTIVARVNPRHVYHVGSSVKLAIDLNKIHIFDAETEESIGFAAGPAGERQEALV

SEQ ID NO: 130 - protein, 384 aa, Artificial
  Substituion in SEQ ID NO 120
MARVLLEHIYKTYPGQTEPTVKDFNLDIQDKEFTVFVGPSGCGKTTTLRMIAGLEDITEGNLYIGDRRVNDVPPKDRDIAMVFQNYALYPHMTVYQNMAFGLKLRKVPKAEIDRRVQEAAKILDIAHLLDRKPKALSGGQRQRVALGRAIVREPQVFLMDEPLSNLDAKLRVQMRAEIRKLHQRLQTTVIYVTHDQTEAMTMGDRIVVMRDGVIQQADTPQVVYSQPKNMFVAGFIGSPAMNFIRGEIVQDGDAFYFRAPSISLRLPEGRYGVLKASGAIGKPVVLGVRPEDLHDEEVFMTTYPDSVLQMQVEVVEHMGSEVYLHTSIGPNTIVARVNPRHVYHVGSSVKLAIDLNRIHIFDAETEESIGFAAGPAGERQEALV

SEQ ID NO: 131 - protein, 384 aa, Artificial
  Substituion in SEQ ID NO 120
MARVLLEHIYKTYPGQTEPTVRDFNLDIQDKEFTVFVGPSGCGKTTTLRMIAGLEDITEGNLYIGDRRVNDVPPKDRDIAMVFQNYALYPHMTVYQNMAFGLKLRKVPKAEIDRRVQEAAKILDIAHLLDRKPKALSGGQRQRVALGRAIVREPQVFLMDEPLSNLDAKLRVQMRAEIRKLHQRLQTTVIYVTHDQTEAMTMGDRIVVMRDGVIQQADTPQVVYSQPKNMFVAGFIGSPAMNFIRGEIVQDGDAFYFRAPSISLRLPEGRYGVLKASGAIGKPVVLGVRPEDLHDEEVFMTTYPDSVLQMQVEVVEHMGSEVYLHTSIGPNTIVARVNPRHVYHVGSSVKLAIDLNKIHIFDAETEESIGFAAGPAGERQEALV

SEQ ID NO: 132 - DNA, 1155 bp, Artificial
  Substituion in SEQ ID NO 121
gtggctcgcgtgttgctcgatcacatttacaagacctaccccggccagacggagccgacggtgaaggacttcaacctcgacattcaggacaaggaattcaccgtgttcgtcggcccctccggctgcggcaagacgacgacgcttcgcatgatcgctggactcgaggacatcacggagggcaacctgtatatcggcgatcgccgcgtgaacgacgtgccgccgaaggatcgggacattgcgatggtgttccaaaactacgcgctctatccccatatgacggtgtatcagaacatggcgttcggcctgaagctgcgcaaggtgccgaaggccgagatcgaccggcgggtgcaggaggcggcgaagatcctcgacatcgcgcacctgctcgaccggaagccgaaggcgctctccggcggtcagcgccagcgcgtggcgttgggtcgcgccattgtgcgcgagccgcaggtgttcctgatggatgagccgctgtcgaacctggacgcgaagctgcgcgtgcagatgcgcgcggagatccgcaagctccatcagcgcttgcaaacgaccgtcatttacgttacacatgatcagacggaagccatgacgatgggcgatcgcatcgtggtcatgcgcgacggcgtcatccagcaggcggatacgccgcaggtcgtgtactcccagccgaagaacatgtttgtcgccggcttcattgggtctcctgccatgaactttattcgcggcgagatcgtgcaggacggcgatgcgttctacttccgcgcgccttccatttcgctgcgcctgccggagggccgctacggcgtgctgaaggcgtcgggggccattgggaagccggtcgtgctcggcgtgcggccggaagacctgcacgatgaggaagtgttcatgacgacgtatcccgactccgtgctgcagatgcaggtggaagtcgtggaacacatgggctcggaggtctatctgcacacgagtatcgggccgaacacgatcgtcgcgcgcgtgaacccgcgccacgtctaccacgtcggaagctcggtcaagctcgcgattgacttgaacaagatccacatcttcgacgcggagacggaggagtccatcggcttcgccgcaggtcctgcgggtgaacgtcaagaagctttggtgtga

SEQ ID NO: 133 - DNA, 1155 bp, Artificial
  Substituion in SEQ ID NO 121
gtggctcgcgtgttgctcgagcacatttacaagacctaccccggccagacggagccgacggtgaaggacttcaacctcgacattcaggacaaggaattcaccgtgttcgtcggcccctccggctgcggcaagacgacgacgcttcgcatgatcgctggactcgaggacatcacggagggcaacctgtatatcggcgatcgccgcgtgaacgacgtgccgccgaaggatcgggacattgcgatggtgttccaaaactacgcgctctatccccatatgacggtgtatcagaacatggcgttcggcctgaagctgcgcaaggtgccgaaggccgagatcgaccggcgggtgcaggaggcggcgaagatcctcgacatcgcgcacctgctcgaccggaagccgaaggcgctctccggcggtcagcgccagcgcgtggcgttgggtcgcgccattgtgcgcgagccgcaggtgttcctgatggatgagccgctgtcgaacctggacgcgaagctgcgcgtgcagatgcgcgcggatatccgcaagctccatcagcgcttgcaaacgaccgtcatttacgttacacatgatcagacggaagccatgacgatgggcgatcgcatcgtggtcatgcgcgacggcgtcatccagcaggcggatacgccgcaggtcgtgtactcccagccgaagaacatgtttgtcgccggcttcattgggtctcctgccatgaactttattcgcggcgagatcgtgcaggacggcgatgcgttctacttccgcgcgccttccatttcgctgcgcctgccggagggccgctacggcgtgctgaaggcgtcgggggccattgggaagccggtcgtgctcggcgtgcggccggaagacctgcacgatgaggaagtgttcatgacgacgtatcccgactccgtgctgcagatgcaggtggaagtcgtggaacacatgggctcggaggtctatctgcacacgagtatcgggccgaacacgatcgtcgcgcgcgtgaacccgcgccacgtctaccacgtcggaagctcggtcaagctcgcgattgacttgaacaagatccacatcttcgacgcggagacggaggagtccatcggcttcgccgcaggtcctgcgggtgaacgtcaagaagctttggtgtga

SEQ ID NO: 134 - DNA, 1155 bp, Artificial
  Substituion in SEQ ID NO 121
gtggctcgcgtgttgctcgagcacatttacaagacctaccccggccagacggagccgacggtgaaggacttcaacctcgacattcaggacaaggaattcaccgtgttcgtcggcccctccggctgcggcaagacgacgacgcttcgcatgatcgctggactcgaggacatcacggagggccaactgtatatcggcgatcgccgcgtgaacgacgtgccgccgaaggatcgggacattgcgatggtgttccaaaactacgcgctctatccccatatgacggtgtatcagaacatggcgttcggcctgaagctgcgcaaggtgccgaaggccgagatcgaccggcgggtgcaggaggcggcgaagatcctcgacatcgcgcacctgctcgaccggaagccgaaggcgctctccggcggtcagcgccagcgcgtggcgttgggtcgcgccattgtgcgcgagccgcaggtgttcctgatggatgagccgctgtcgaacctggacgcgaagctgcgcgtgcagatgcgcgcggagatccgcaagctccatcagcgcttgcaaacgaccgtcatttacgttacacatgatcagacggaagccatgacgatgggcgatcgcatcgtggtcatgcgcgacggcgtcatccagcaggcggatacgccgcaggtcgtgtactcccagccgaagaacatgtttgtcgccggcttcattgggtctcctgccatgaactttattcgcggcgagatcgtgcaggacggcgatgcgttctacttccgcgcgccttccatttcgctgcgcctgccggagggccgctacggcgtgctgaaggcgtcgggggccattgggaagccggtcgtgctcggcgtgcggccggaagacctgcacgatgaggaagtgttcatgacgacgtatcccgactccgtgctgcagatgcaggtggaagtcgtggaacacatgggctcggaggtctatctgcacacgagtatcgggccgaacacgatcgtcgcgcgcgtgaacccgcgccacgtctaccacgtcggaagctcggtcaagctcgcgattgacttgaacaagatccacatcttcgacgcggagacggaggagtccatcggcttcgccgcaggtcctgcgggtgaacgtcaagaagctttggtgtga

SEQ ID NO: 135 - DNA, 1155 bp, Artificial
  Substituion in SEQ ID NO 121
gtggctcgcgtgttgctcgagcacatttacaagacctaccccggccagacggagccgacggtgaaggacttcaacctcgacattcaggacaaggaattcaccgtgttcgtcggcccctccggctgcggcaagacgacgacgcttcgcatgatcgctggactcgaggacatcacggagggcaacctgtatatcggcgatcgccgcgtgaacgacgtgccgccgaaggatcgggacattgcgatggtgttccaaaactacgcgctctatccccatatgacggtgtatcagaacatggcgttcggcctgaagctgcgcaaggtgccgaaggccgagatcgaccggcgggtgcaggaggcggcgaagatcctcgacatcgcgcacctgctcgaccggaagccgaaggcgctctccggcggtcagcgccagcgcgtggcgttgggtcgcgccattgtgcgcgagccgcaggtgttcctgatggatgagccgctgtcgaacctggacgcgaagctgcgcgtgcagatgcgcgcggagatccgcaagctccatcagcgcttgcaaacgaccgtcatttacgttacacatgatcagacggaagccatgacgatgggcgatcgcatcgtggtcatgcgcgacggcgtcatccagcaggcggatacgccgcaggtcgtgtactcccagccgaagaacatgtttgtcgccggcttcattgggtctcctgccatgaactttattcgcggcgagatcgtgcaggacggcgatgcgttctacttccgcgcgccttccatttcgctgcgcctgccggagggccgctacggcgtgctgaaggcgtcgggggccattgggaagccggtcgtgctcggcgtgcggccggaagacctgcacgatgaggaagtgttcatgacgacgtatcccgactccgtgctgcagatgcaggtggaagtcgtggaacacatgggctcggaggtctatctgcacacgagtatcgggccgaacacgatcgtcgcgcgcgtgaacccgcgccacgtctaccacgtcggaagctcggtcaagctcgcgattgacttgaaccgtatccacatcttcgacgcggagacggaggagtccatcggcttcgccgcaggtcctgcgggtgaacgtcaagaagctttggtgtga

SEQ ID NO: 136 - DNA, 1155 bp, Artificial
  Substituion in SEQ ID NO 121
gtggctcgcgtgttgctcgagcacatttacaagacctaccccggccagacggagccgacggtgcgtgacttcaacctcgacattcaggacaaggaattcaccgtgttcgtcggcccctccggctgcggcaagacgacgacgcttcgcatgatcgctggactcgaggacatcacggagggcaacctgtatatcggcgatcgccgcgtgaacgacgtgccgccgaaggatcgggacattgcgatggtgttccaaaactacgcgctctatccccatatgacggtgtatcagaacatggcgttcggcctgaagctgcgcaaggtgccgaaggccgagatcgaccggcgggtgcaggaggcggcgaagatcctcgacatcgcgcacctgctcgaccggaagccgaaggcgctctccggcggtcagcgccagcgcgtggcgttgggtcgcgccattgtgcgcgagccgcaggtgttcctgatggatgagccgctgtcgaacctggacgcgaagctgcgcgtgcagatgcgcgcggagatccgcaagctccatcagcgcttgcaaacgaccgtcatttacgttacacatgatcagacggaagccatgacgatgggcgatcgcatcgtggtcatgcgcgacggcgtcatccagcaggcggatacgccgcaggtcgtgtactcccagccgaagaacatgtttgtcgccggcttcattgggtctcctgccatgaactttattcgcggcgagatcgtgcaggacggcgatgcgttctacttccgcgcgccttccatttcgctgcgcctgccggagggccgctacggcgtgctgaaggcgtcgggggccattgggaagccggtcgtgctcggcgtgcggccggaagacctgcacgatgaggaagtgttcatgacgacgtatcccgactccgtgctgcagatgcaggtggaagtcgtggaacacatgggctcggaggtctatctgcacacgagtatcgggccgaacacgatcgtcgcgcgcgtgaacccgcgccacgtctaccacgtcggaagctcggtcaagctcgcgattgacttgaacaagatccacatcttcgacgcggagacggaggagtccatcggcttcgccgcaggtcctgcgggtgaacgtcaagaagctttggtgtga

SEQ ID NO: 137 - protein, 434 aa, Alicyclobacillus acidocaldarius
MSMAQVGLHPSVRPRPSAAKKTAYAANQIAVNMLWQAFNAVAVYDYVAYHGVSAVRLSSGLIVYGVLNALFNLVAGHVSDRTKTRFGRRIPYVAVASIPYAVCFALLFSPPHLSQTGLVVYFLAMTFLFDLAFTFTALNANALYPEMYPDPRDRAYVSALQQVFGIVGLIAGVALSKSLGQALGWSRMAWIFAAVAVASMYVSLWGSFETGDPAEPFAWREALRETFRNRAFIWYVIASFLVQFTTTLFTTASSFYTSYVVRLSPLQNSLFLGGIFVVAMPIAFVWARAAIRYGASRSAMVAIALYACVEALLLVDRSPTSVLVTGLCLGVPVAGFMVLLNMLLAEVIDLDARRTGRRREGMYLGMNGCIVRLGLSLQYAVMAIFFAVSGYRAGASVQPTSAVEGLRLLLGLVPALFLAGAFLCMRVYDRTRTR

SEQ ID NO: 138 - DNA, 1305 bp, Alicyclobacillus acidocaldarius
gtgtccatggcgcaagttggcctccatccttctgttcggccgcgcccgtcggctgcgaaaaagaccgcatacgcagccaatcaaatcgccgtcaacatgctttggcaggcgttcaacgccgtggcggtgtacgattacgtggcctatcacggcgtgtccgcggtccggctatcgagcggcctcatcgtctacggggtgctgaacgccttgttcaacctcgtggcgggccacgtgagcgaccgcaccaagacccgcttcggccggcgcattccgtacgtcgccgtcgcatccatcccgtatgccgtgtgtttcgcgcttttgttctctccgccacacctctcgcagaccggcctcgtcgtgtactttttggccatgacgttcttgttcgatctcgccttcaccttcacggccctcaacgcgaacgcgttgtacccggagatgtacccagatccgcgcgatcgcgcgtacgtgtcggcgcttcagcaggtctttggcatcgtcgggctcatcgccggcgtcgccttgtcgaaatcgcttgggcaggccctcggctggtcgcgcatggcctggatcttcgccgcggtggccgtcgcgtcgatgtacgtgtccctctggggaagctttgaaacgggcgatcccgccgaaccgttcgcgtggcgggaggcgctgcgcgagacgttccgaaatcgcgcgttcatttggtacgtgatcgcgagcttcctcgtccagttcacgactacgctcttcaccacggcctcctcgttctacacgtcgtacgtggtgcgtctcagtccgctgcaaaactcgctctttctcggcggaatcttcgtcgtcgcgatgcccatcgcgtttgtgtgggctcgcgccgcgattcgatacggcgcttcgcggtcggccatggtcgccatcgcgctgtacgcgtgcgtcgaggcgctccttctcgtcgatcggtcgcccacttccgtgctcgtgaccgggctttgcctcggcgtccccgtcgcgggcttcatggtcctcttgaacatgctcttggccgaggtgatcgatctcgacgcgcgccgcacaggccgccgccgcgaagggatgtatctgggcatgaacgggtgcatcgtgcgactcggcctatccctgcagtacgccgtgatggccatctttttcgcggtctcgggctatcgggcgggcgccagcgtccaaccgacgagtgcggtggagggcttacggctgttgctcggcctcgtccctgcactctttcttgcgggcgcgttcctgtgcatgcgggtgtacgaccgaacgcgcacgcgatga

SEQ ID NO: 139 - protein, 384 aa, Thermoanaerobacter tengcongensis MB4
KKVAYSFGNFPIGIMLEAFGTYVMFFYIDVLKVDPSFISLAFVIHGIIFAIFNPLIGYVSDKTETRWGRRRPYIAFGIVPLALVFYVIWSPFVSKEFLPAYFLTVIILFDFLYVLVGLNLAALFPEMFPSLEERAQVSAYRQMFGILGSIIGVVLPPIIYSRYGWNVLGIIFGTLIAIGFFIAFYGCEEKKNIKIPSIPVLTAFKYVFLNKAFLPFVVGGFFAKFLLTSVPAAIPFFTKYVLRIPEKEVSLLLGSIFVTAIPMMLVWSKITKKFGSRKAMFLSIGFLILVFPAYFFVNTFVETLIVSVIFGALLAGVVMLLDVMLAEVIDEDTKNTGMKREGMYTGVFGFIIRFGYSLQGIVIGGILKLSGYIPNVLEQPSSAI

SEQ ID NO: 140 - protein, 390 aa, Thermotoga lettingae TMO
KNFLYSLGSFSSALFSNAISTFAIFYYVDVLKAPPHLISIIMVLYGIWNAINDPLFGYLSDTTKTRWGRRKPYIVWFSLPLTISFAMFWAPPFDSSQKTALVIYYLIMIFLFDTFFTIVFLNWTALFPEMYPTLKERAKISGLRQILAIPGLLLGVAVTPVIAAKIGWGKMGAVFAVIGGSILYMTLFGIKENPEFSHQQTLNIIEAIKFTFFNRSFFTYVVPSFLLQFTYTMLTATLPFYAKYVLKASETQTTLLLASIFVVAFFLIPVWQKITAKIGAKKTMKVSMILWAILLIGFGFVKTFFQAIILTSALAMSLAGALIVFDIMIADISDEDEIKTGKRREGMYFGANALIIRLGISLNSLIMGFVLSSSGYDANLPAEMQPLTAV

SEQ ID NO: 141 - protein, 381 aa, Thermus thermophilus HB8
AYALGGLGLTLPAQTFGTYLAFYYLDRLGMPAGAFALARLIFSVWDAVNDPLFGYLSDRTRTPWGRRRPWLFLSLPFLLLAFYLAFSVPEAFRKGTRLFWYGLWAMLLFETFSALAWVNHAALFPELFQSREERARANAWRQGFYFLGLTASIALTPLVYAALGFPGMALLYGAVGGGLVLLFLLSVREDPRAREAEPLPFVPAFRYTLGNRAFWIYALAALFLLFAVGLFAAAMPFYAKHALGLGEEATALLFASVLLAALPSVSLWARLAGALGPKRAWLWAIGLLALGALLLLWPRGLLEALPVGVLIGTGFGGVLVLGDVLLAEVIDRDAAATGRRREGVYYSVYGFINRLSGPLQALAFALLTPLFGYVSGENPGP

SEQ ID NO: 142 - protein, 381 aa, Thermus thermophilus HB27
AYALGGLGLTLPAQTFGTYLAFYYLDRLGMPTGAFALARLIFSVWDAVNDPLFGYLSDRTRTPWGRRRPWLFLSLPFLLLAFYLAFSVPEAFREGTRLFWYGLWAMLLFETFSALAWVNHAALFPELFQSREERARANAWRQGFYFLGLTASIALTPLVYAALGFPGMALLYGAVGGGLVLLFLLSVREDPRAREAEPLPFVPAFRYTLGNRAFWIYALAALFLLFAVGLFAAAMPFYAKYALGLGEEATALLFASVLLAALPSVSLWARLAGALGPKRAWLWAIGLLALGALLLLWPRGLLEALPVGVLIGTGFGGVLVLGDVLLAEVIDRDAAATGRRREGVYYSVYGFVNRLSGPLQALAFALLTPLFGYVSGENPGP

SEQ ID NO: 143 - protein, 394 aa, Roseiflexus castenholzii DSM 13941
AYSMGNFANTIAYQVFGNRIQFYYVDVLGLNAAAAGVIWTIYGLWNAINDPLMGQLSDRTRTPMGRRVPYVLFGAVPLGLSFFFLWTPPGQSPWLLAAYFLIILFIFDTLYSLTIIAYNALFPEVAPHLKARIDLSAVREVLATIALLLSFILAPILAEGVGYIWMGAIMGTLVAVGYLISMAGVREDISKIKDDRFGLIESLRIALSSRPFRWFIGANIAKEYIWLVLAAMLPFWRKYALGIQGQTEVFGMRLSGGDAEAILLGVPILLTIPMLLIWRPMVARIGPRRSWIITSFCFIPGFLAMILANDFYTGLIGTLLVVPGLAGSMIMPFPLISEVIDDDAARHGYRREGIFFGINGGITKLAFSAQGVLFAAVLSLSGYVAGSDAQPESA

SEQ ID NO: 144 - protein, 434 aa, Artificial
  Substituion in SEQ ID NO 137
MSMAQVGLHPSVRPRPSAAKRTAYAANQIAVNMLWQAFNAVAVYDYVAYHGVSAVRLSSGLIVYGVLNALFNLVAGHVSDRTKTRFGRRIPYVAVASIPYAVCFALLFSPPHLSQTGLVVYFLAMTFLFDLAFTFTALNANALYPEMYPDPRDRAYVSALQQVFGIVGLIAGVALSKSLGQALGWSRMAWIFAAVAVASMYVSLWGSFETGDPAEPFAWREALRETFRNRAFIWYVIASFLVQFTTTLFTTASSFYTSYVVRLSPLQNSLFLGGIFVVAMPIAFVWARAAIRYGASRSAMVAIALYACVEALLLVDRSPTSVLVTGLCLGVPVAGFMVLLNMLLAEVIDLDARRTGRRREGMYLGMNGCIVRLGLSLQYAVMAIFFAVSGYRAGASVQPTSAVEGLRLLLGLVPALFLAGAFLCMRVYDRTRTR

SEQ ID NO: 145 - protein, 434 aa, Artificial
  Substituion in SEQ ID NO 137
MSMAQVGLHPSVRPRPSAAKKTAYAANQIAVNMLWQAFNAVAVYDYVAYHGVSAVRLSSGLIVYGVLNALFNLVAGHVSDRTKTRFGRRIPYVAVASIPYAVCFALLFSPPHLSQTGLVVYFLAMTFLFDLAFTFTALNANALYPEMYPDPRDRAYVSALQQVFGIVGLIAGVALSKSLGQALGWSRMAWIFAAVAVASMYVSLWGSFETGDPAEPFAWREALRETFRNRAFIWYVIASFLVQFTTTLFTTASSFYTSYVVRLSPLQNSLFLGGIFVVAMPIAFVWARAAIRYGASRSAMVAIALYACVEALLLVDRSPTSVLVTGLCLGVPVAGFMVLLNMLLAEVIDLDARRTGRRREGMYLGMNGCIVRLGLSLQYAVMAIFFAVSGYRAGASVQPTSAVEGIRLLLGLVPALFLAGAFLCMRVYDRTRTR

SEQ ID NO: 146 - protein, 434 aa, Artificial
  Substituion in SEQ ID NO 137
MSMAQVGLHPSVRPRPSAAKKTAYAANQIAVNMLWQAFNAVAVYDYVAYHGVSAVRLSSGLIVYGVLNALFNLVAGHVSDRTKTRFGRRIPYVAVASIPYAVCFALLFSPPHLSQTGLVVYFLAMTFLFDLAFTFTALNANALYPEMYPDPRDRAYISALQQVFGIVGLIAGVALSKSLGQALGWSRMAWIFAAVAVASMYVSLWGSFETGDPAEPFAWREALRETFRNRAFIWYVIASFLVQFTTTLFTTASSFYTSYVVRLSPLQNSLFLGGIFVVAMPIAFVWARAAIRYGASRSAMVAIALYACVEALLLVDRSPTSVLVTGLCLGVPVAGFMVLLNMLLAEVIDLDARRTGRRREGMYLGMNGCIVRLGLSLQYAVMAIFFAVSGYRAGASVQPTSAVEGLRLLLGLVPALFLAGAFLCMRVYDRTRTR

SEQ ID NO: 147 - protein, 434 aa, Artificial
  Substituion in SEQ ID NO 137
MSMAQVGLHPSVRPRPSAAKKTAYAANQIAVNMLWQAFNAVAVYDYVAYHGVSAVRLSSGLIVYGVLNALFNLVAGHVSDRTKTRFGRRIPYVAVASIPYAVCFALLFSPPHLSQTGLVVYFLAMTFLFDLAFTFTALNANALYPEMYPDPRDRAYVSALQQVFGIVGLIAGVALSKSLGQALGWSRMAWIFAAVAVASMYVSLWGSFETGDPAEPFAWREALRETFRNRAFIWYVIASFLVQFTTTLFTTASSFYTSYVVRLSPLQNSLFIGGIFVVAMPIAFVWARAAIRYGASRSAMVAIALYACVEALLLVDRSPTSVLVTGLCLGVPVAGFMVLLNMLLAEVIDLDARRTGRRREGMYLGMNGCIVRLGLSLQYAVMAIFFAVSGYRAGASVQPTSAVEGLRLLLGLVPALFLAGAFLCMRVYDRTRTR

SEQ ID NO: 148 - protein, 434 aa, Artificial
  Substituion in SEQ ID NO 137
MSMAQVGLHPSVRPRPSAAKKTAYAANQIAVNMLWQAFNAVAVYDYVAYHGVSAVRLSSGLIVYGVLNALFNLVAGHVSDRTKTRFGRRIPYVAVASIPYAVCFALLFSPPHLSQTGLVVYFLAMTFLFDLAFTFTALNANALYPEMYPDPRDRAYVSALQQVFGIVGLIAGVALSKSIGQALGWSRMAWIFAAVAVASMYVSLWGSFETGDPAEPFAWREALRETFRNRAFIWYVIASFLVQFTTTLFTTASSFYTSYVVRLSPLQNSLFLGGIFVVAMPIAFVWARAAIRYGASRSAMVAIALYACVEALLLVDRSPTSVLVTGLCLGVPVAGFMVLLNMLLAEVIDLDARRTGRRREGMYLGMNGCIVRLGLSLQYAVMAIFFAVSGYRAGASVQPTSAVEGLRLLLGLVPALFLAGAFLCMRVYDRTRTR

SEQ ID NO: 149 - DNA, 1305 bp, Artificial
  Substituion in SEQ ID NO 138
gtgtccatggcgcaagttggcctccatccttctgttcggccgcgcccgtcggctgcgaaacgtaccgcatacgcagccaatcaaatcgccgtcaacatgctttggcaggcgttcaacgccgtggcggtgtacgattacgtggcctatcacggcgtgtccgcggtccggctatcgagcggcctcatcgtctacggggtgctgaacgccttgttcaacctcgtggcgggccacgtgagcgaccgcaccaagacccgcttcggccggcgcattccgtacgtcgccgtcgcatccatcccgtatgccgtgtgtttcgcgcttttgttctctccgccacacctctcgcagaccggcctcgtcgtgtactttttggccatgacgttcttgttcgatctcgccttcaccttcacggccctcaacgcgaacgcgttgtacccggagatgtacccagatccgcgcgatcgcgcgtacgtgtcggcgcttcagcaggtctttggcatcgtcgggctcatcgccggcgtcgccttgtcgaaatcgcttgggcaggccctcggctggtcgcgcatggcctggatcttcgccgcggtggccgtcgcgtcgatgtacgtgtccctctggggaagctttgaaacgggcgatcccgccgaaccgttcgcgtggcgggaggcgctgcgcgagacgttccgaaatcgcgcgttcatttggtacgtgatcgcgagcttcctcgtccagttcacgactacgctcttcaccacggcctcctcgttctacacgtcgtacgtggtgcgtctcagtccgctgcaaaactcgctctttctcggcggaatcttcgtcgtcgcgatgcccatcgcgtttgtgtgggctcgcgccgcgattcgatacggcgcttcgcggtcggccatggtcgccatcgcgctgtacgcgtgcgtcgaggcgctccttctcgtcgatcggtcgcccacttccgtgctcgtgaccgggctttgcctcggcgtccccgtcgcgggcttcatggtcctcttgaacatgctcttggccgaggtgatcgatctcgacgcgcgccgcacaggccgccgccgcgaagggatgtatctgggcatgaacgggtgcatcgtgcgactcggcctatccctgcagtacgccgtgatggccatctttttcgcggtctcgggctatcgggcgggcgccagcgtccaaccgacgagtgcggtggagggcttacggctgttgctcggcctcgtccctgcactctttcttgcgggcgcgttcctgtgcatgcgggtgtacgaccgaacgcgcacgcgatga

SEQ ID NO: 150 - DNA, 1305 bp, Artificial
  Substituion in SEQ ID NO 138
gtgtccatggcgcaagttggcctccatccttctgttcggccgcgcccgtcggctgcgaaaaagaccgcatacgcagccaatcaaatcgccgtcaacatgctttggcaggcgttcaacgccgtggcggtgtacgattacgtggcctatcacggcgtgtccgcggtccggctatcgagcggcctcatcgtctacggggtgctgaacgccttgttcaacctcgtggcgggccacgtgagcgaccgcaccaagacccgcttcggccggcgcattccgtacgtcgccgtcgcatccatcccgtatgccgtgtgtttcgcgcttttgttctctccgccacacctctcgcagaccggcctcgtcgtgtactttttggccatgacgttcttgttcgatctcgccttcaccttcacggccctcaacgcgaacgcgttgtacccggagatgtacccagatccgcgcgatcgcgcgtacgtgtcggcgcttcagcaggtctttggcatcgtcgggctcatcgccggcgtcgccttgtcgaaatcgcttgggcaggccctcggctggtcgcgcatggcctggatcttcgccgcggtggccgtcgcgtcgatgtacgtgtccctctggggaagctttgaaacgggcgatcccgccgaaccgttcgcgtggcgggaggcgctgcgcgagacgttccgaaatcgcgcgttcatttggtacgtgatcgcgagcttcctcgtccagttcacgactacgctcttcaccacggcctcctcgttctacacgtcgtacgtggtgcgtctcagtccgctgcaaaactcgctctttctcggcggaatcttcgtcgtcgcgatgcccatcgcgtttgtgtgggctcgcgccgcgattcgatacggcgcttcgcggtcggccatggtcgccatcgcgctgtacgcgtgcgtcgaggcgctccttctcgtcgatcggtcgcccacttccgtgctcgtgaccgggctttgcctcggcgtccccgtcgcgggcttcatggtcctcttgaacatgctcttggccgaggtgatcgatctcgacgcgcgccgcacaggccgccgccgcgaagggatgtatctgggcatgaacgggtgcatcgtgcgactcggcctatccctgcagtacgccgtgatggccatctttttcgcggtctcgggctatcgggcgggcgccagcgtccaaccgacgagtgcggtggagggcattcggctgttgctcggcctcgtccctgcactctttcttgcgggcgcgttcctgtgcatgcgggtgtacgaccgaacgcgcacgcgatga

SEQ ID NO: 151 - DNA, 1305 bp, Artificial
  Substituion in SEQ ID NO 138
gtgtccatggcgcaagttggcctccatccttctgttcggccgcgcccgtcggctgcgaaaaagaccgcatacgcagccaatcaaatcgccgtcaacatgctttggcaggcgttcaacgccgtggcggtgtacgattacgtggcctatcacggcgtgtccgcggtccggctatcgagcggcctcatcgtctacggggtgctgaacgccttgttcaacctcgtggcgggccacgtgagcgaccgcaccaagacccgcttcggccggcgcattccgtacgtcgccgtcgcatccatcccgtatgccgtgtgtttcgcgcttttgttctctccgccacacctctcgcagaccggcctcgtcgtgtactttttggccatgacgttcttgttcgatctcgccttcaccttcacggccctcaacgcgaacgcgttgtacccggagatgtacccagatccgcgcgatcgcgcgtacatttcggcgcttcagcaggtctttggcatcgtcgggctcatcgccggcgtcgccttgtcgaaatcgcttgggcaggccctcggctggtcgcgcatggcctggatcttcgccgcggtggccgtcgcgtcgatgtacgtgtccctctggggaagctttgaaacgggcgatcccgccgaaccgttcgcgtggcgggaggcgctgcgcgagacgttccgaaatcgcgcgttcatttggtacgtgatcgcgagcttcctcgtccagttcacgactacgctcttcaccacggcctcctcgttctacacgtcgtacgtggtgcgtctcagtccgctgcaaaactcgctctttctcggcggaatcttcgtcgtcgcgatgcccatcgcgtttgtgtgggctcgcgccgcgattcgatacggcgcttcgcggtcggccatggtcgccatcgcgctgtacgcgtgcgtcgaggcgctccttctcgtcgatcggtcgcccacttccgtgctcgtgaccgggctttgcctcggcgtccccgtcgcgggcttcatggtcctcttgaacatgctcttggccgaggtgatcgatctcgacgcgcgccgcacaggccgccgccgcgaagggatgtatctgggcatgaacgggtgcatcgtgcgactcggcctatccctgcagtacgccgtgatggccatctttttcgcggtctcgggctatcgggcgggcgccagcgtccaaccgacgagtgcggtggagggcttacggctgttgctcggcctcgtccctgcactctttcttgcgggcgcgttcctgtgcatgcgggtgtacgaccgaacgcgcacgcgatga

SEQ ID NO: 152 - DNA, 1305 bp, Artificial
  Substituion in SEQ ID NO 138
gtgtccatggcgcaagttggcctccatccttctgttcggccgcgcccgtcggctgcgaaaaagaccgcatacgcagccaatcaaatcgccgtcaacatgctttggcaggcgttcaacgccgtggcggtgtacgattacgtggcctatcacggcgtgtccgcggtccggctatcgagcggcctcatcgtctacggggtgctgaacgccttgttcaacctcgtggcgggccacgtgagcgaccgcaccaagacccgcttcggccggcgcattccgtacgtcgccgtcgcatccatcccgtatgccgtgtgtttcgcgcttttgttctctccgccacacctctcgcagaccggcctcgtcgtgtactttttggccatgacgttcttgttcgatctcgccttcaccttcacggccctcaacgcgaacgcgttgtacccggagatgtacccagatccgcgcgatcgcgcgtacgtgtcggcgcttcagcaggtctttggcatcgtcgggctcatcgccggcgtcgccttgtcgaaatcgcttgggcaggccctcggctggtcgcgcatggcctggatcttcgccgcggtggccgtcgcgtcgatgtacgtgtccctctggggaagctttgaaacgggcgatcccgccgaaccgttcgcgtggcgggaggcgctgcgcgagacgttccgaaatcgcgcgttcatttggtacgtgatcgcgagcttcctcgtccagttcacgactacgctcttcaccacggcctcctcgttctacacgtcgtacgtggtgcgtctcagtccgctgcaaaactcgctctttattggcggaatcttcgtcgtcgcgatgcccatcgcgtttgtgtgggctcgcgccgcgattcgatacggcgcttcgcggtcggccatggtcgccatcgcgctgtacgcgtgcgtcgaggcgctccttctcgtcgatcggtcgcccacttccgtgctcgtgaccgggctttgcctcggcgtccccgtcgcgggcttcatggtcctcttgaacatgctcttggccgaggtgatcgatctcgacgcgcgccgcacaggccgccgccgcgaagggatgtatctgggcatgaacgggtgcatcgtgcgactcggcctatccctgcagtacgccgtgatggccatctttttcgcggtctcgggctatcgggcgggcgccagcgtccaaccgacgagtgcggtggagggcttacggctgttgctcggcctcgtccctgcactctttcttgcgggcgcgttcctgtgcatgcgggtgtacgaccgaacgcgcacgcgatga

SEQ ID NO: 153 - DNA, 1305 bp, Artificial
  Substituion in SEQ ID NO 138
gtgtccatggcgcaagttggcctccatccttctgttcggccgcgcccgtcggctgcgaaaaagaccgcatacgcagccaatcaaatcgccgtcaacatgctttggcaggcgttcaacgccgtggcggtgtacgattacgtggcctatcacggcgtgtccgcggtccggctatcgagcggcctcatcgtctacggggtgctgaacgccttgttcaacctcgtggcgggccacgtgagcgaccgcaccaagacccgcttcggccggcgcattccgtacgtcgccgtcgcatccatcccgtatgccgtgtgtttcgcgcttttgttctctccgccacacctctcgcagaccggcctcgtcgtgtactttttggccatgacgttcttgttcgatctcgccttcaccttcacggccctcaacgcgaacgcgttgtacccggagatgtacccagatccgcgcgatcgcgcgtacgtgtcggcgcttcagcaggtctttggcatcgtcgggctcatcgccggcgtcgccttgtcgaaatcgattgggcaggccctcggctggtcgcgcatggcctggatcttcgccgcggtggccgtcgcgtcgatgtacgtgtccctctggggaagctttgaaacgggcgatcccgccgaaccgttcgcgtggcgggaggcgctgcgcgagacgttccgaaatcgcgcgttcatttggtacgtgatcgcgagcttcctcgtccagttcacgactacgctcttcaccacggcctcctcgttctacacgtcgtacgtggtgcgtctcagtccgctgcaaaactcgctctttctcggcggaatcttcgtcgtcgcgatgcccatcgcgtttgtgtgggctcgcgccgcgattcgatacggcgcttcgcggtcggccatggtcgccatcgcgctgtacgcgtgcgtcgaggcgctccttctcgtcgatcggtcgcccacttccgtgctcgtgaccgggctttgcctcggcgtccccgtcgcgggcttcatggtcctcttgaacatgctcttggccgaggtgatcgatctcgacgcgcgccgcacaggccgccgccgcgaagggatgtatctgggcatgaacgggtgcatcgtgcgactcggcctatccctgcagtacgccgtgatggccatctttttcgcggtctcgggctatcgggcgggcgccagcgtccaaccgacgagtgcggtggagggcttacggctgttgctcggcctcgtccctgcactctttcttgcgggcgcgttcctgtgcatgcgggtgtacgaccgaacgcgcacgcgatga

SEQ ID NO: 154 - protein, 438 aa, Alicyclobacillus acidocaldarius
MKHKNKALMATATAVVMCAWMATGCGDEETGGGGGIPMTKSSNASGQAASTAQPVTITFEESMPGKLGTELQKLTNEFEKQNPNIHVQLIFNGSYSTLEQKLTAAIASGTEPTVAQVEETWETNYVQNGLIEPLDSVIPKSTQNDLIPIWRQDSTYNGKLMSVPFNKSAYVLYYNVDDLKKAGISSPPTTWSQLEQDAIKIQKKEGIPGLGLQGNYYTFEMLLKQAGGQILNARNTKAAFDSSAGLAALHFMKRLVDEHAAKVIGANEYLSDGFNTNEYAMDLDTVAAMSFINNSNLHWKVAPLPKGVTYAVPTAGLNLVIFNAATSAQKAAAAKYLNFLISVPSTIEWAEQTGYLPVRQSALTNSAWTSFIKTHPNQGVAPNELKYAYFSPRLASLYSAEQEMTTQIGNMLAGRQTPQVTLQNMANITNQALAQGNS

SEQ ID NO: 155 - DNA, 1317 bp, Alicyclobacillus acidocaldarius
gtgaaacacaaaaacaaggccctcatggcgacagccacagcggtggtgatgtgcgcgtggatggccactggatgcggagacgaggagaccggcggcgggggcggaatccccatgaccaagtcctccaacgcatcgggacaagccgcgagcaccgcgcaacctgtgaccatcacctttgaggaatccatgcctggcaagctcgggaccgaactccaaaagctgacgaacgagtttgagaagcaaaatcccaacatccacgtgcagctcatcttcaatggctcgtacagcacgttggagcagaagttgaccgccgccattgcgtccggcacagagcccacggtggcgcaggtcgaggagacgtgggagacgaattacgtgcagaacggtctgattgagcccctcgactccgtcattccgaaatccacgcagaacgatctaatcccgatttggcgtcaggactcgacgtacaacggcaagttgatgtccgttcccttcaacaagtccgcctacgtcctgtactacaatgtggacgatttaaagaaggccgggatttcttcgccgccgacaacctggagccagctcgaacaggatgccatcaagattcaaaagaaagaaggcattccgggcctcggcctgcagggcaactattacacctttgaaatgctcttaaaacaagcgggtggacagatcctgaacgccagaaacaccaaggcggccttcgatagctcagccggtctcgcagcgctccatttcatgaagcgcttggtggatgaacacgcggccaaggtcatcggcgcgaacgaatacctctccgacggtttcaacacgaacgagtacgcgatggacctcgacacggtcgccgcgatgtcgttcatcaacaactcgaacctccattggaaagttgcgccgctcccaaagggcgtgacctacgccgtccccacggccggtttgaacttggtcattttcaacgcagcgacatccgctcagaaagcggcggcggcgaagtatctgaacttcctcatttctgtaccatcgaccatcgagtgggcggaacagacaggctacctccccgtccgccaaagcgcactcaccaattcggcctggacgagcttcatcaagacccatccgaatcagggggtcgcacccaacgagctgaaatacgcctatttctcccctcggctcgcttcgctctactccgcggagcaagagatgaccacacagattggcaacatgctggcgggtcggcagacgccgcaggtgaccctgcagaacatggcgaacatcacgaaccaagcgctcgcccagggcaattcatga

SEQ ID NO: 156 - protein, 392 aa, Thermotoga sp. RQ2
VKVTFWHAMGGGHGETLQEIVNTFNELHPDIEVEAVYVGNYSALSQKLLAAAQAGELPTISQSYSNWTAKLIQSGVVQPLNEFVNDPKIGLTKEEWEDIFKPLRDNCMWGDTIYAVPFNKSLYILYYNADAFAMYGVDVPKTIDELYEAARIMTEDLDGDGNIDQYGFGFRTTVDFFQILLLLRGGSILKQVDGKWVSNIDSQETRDVLAFVKKMVDDGIAYFQGGYLNDIFGQQKIMMYIDTIAGRPYVESSTKGKFTWSWAPVPTWVTNKVPFAGTDIIMFNTASDEEKRAAWEFMKYLISPEVTAYWAINTGYIPVRRSALETSIWKEAAKSDPLIEIPLKQIDNAMFDPQIGVWYEIRTVVGNMFSDFINGKVDMETAIKTADQKIRE

SEQ ID NO: 157 - protein, 392 aa, Thermotoga petrophila RKU-1
VKVTFWHAMGGGHGKTLQEIVNTFNELHPDIEVEAVYVGNYGALSQKLLAAAQAGELPTIAQSYSNWTAKLIQSGVVQPLNEFVNDPKIGLTREEWEDVFKPLRDNCMWGDTVYAVPFNKSLYILYYNADAFAMYGVDVPKTIDELYEAARIMTEDLDGDGKIDQYGFGFRTTVDFFQILLILRGGSILKQVDGKWVSNIDSQETREVLAFVKKMVDDGIAYFQGGYLNDIFGQQKIMMYIDTIAGRPYVESSTKGKFTWSWAPVPTWVTNKVPFAGTDIIMFNTASDEEKRAAWEFMKYLISPEVTAYWAINTGYIPVRRSALETSIWKEAAKSDPLIEIPLKQIDNAVFDPQIGVWYEIRTVVGNMFSDFINGKVDMETAIKTADQKIRE

SEQ ID NO: 158 - protein, 413 aa, Clostridium botulinum F str. Langeland
KEESKATIATEIKEPVTIEFWHAMSGDNEAALKEITEEFNKKNKDKITVKLVYQGQYKELFSKLDGAAKSKKLPALTMIYPNRLTAYVMNDLVENLNPYIENEKIGFKKDVWDDIPEFVRDNGMWNDKHYSLPFNKGTYLLFYNEDLLKKYNVKVPNNWNELKEASKKLTVDTNGDGKNDIYGLGLNSSVGIDSSFWVEQAGGHLIDEANDKLLFNSKEGVEAFDFLSELVKSGNAKISTEEKYMTGAFSRGEAAMGISSISALPDIIKACKGNNINFKTAVLPEGKKKAALFSGTDVAIFNTPSPEEKLAAFEYLKFFMEKESQTRWATKSGYLPLRKSVIDSKEFKDYVEKENPAKGEAVKEFDYGYCDPKVLNGYAIHDNMAKALDQIIAGKKDSKQALSDAEKKARQEL

SEQ ID NO: 159 - protein, 413 aa, Clostridium botulinum A str. ATCC 3502
KEESKATIATEIKEPVTIEFWHAMNGDNEAALKEITEEFNKKNKDKITVKLVYQGQYKELFSKLDGAAKSKKLPALTMIYPNRLTAYVMNDLVENLNPYIENEKIGFKKDVWDDIPEFVRDNGMWNDKHYSLPFNKGTYLLFYNEDLLKKYNVKVPNNWNELKEASKKLTVDTNGDGKNDIYGLGLNSSVGIDSSFWVEQAGGHLIDEANDKLLFNSKEGAEAFDFLSELVKSGNAKISTEEKYMTGAFSRGEAAMGISSISALPDIIKACKGNNINFKTAVLPEGKKKAALFSGTDVAIFNTPSPEEKLAAFEYLKFFMEKESQTKWATKSGYLPLRKSVIDSKEFKDYVEKENPAKGEAVKEFDYGYCDPKVLNGYAIHDNMAKALDQIIAGKKDSKQALSDAEKKARQEL

SEQ ID NO: 160 - protein, 392 aa, Thermotoga maritima MSB8
VKVTFWHAMGGGHGKTLQEIVNTFNELHPDIEVEAVYVGNYGALSQKLLAAAQAGELPTISQAYSNWTAKLIQSGVVQPLNEFVNDPKIGLTKEEWEDIFKPLRDNCMWGDTIYAVPFNKSLYVLYYNADAFAMYGVDVPKTIDELYEAARIMTEDFDGDGKIDQYGFGFRTTVDFFQILLTLRGGSILKQVDGKWVSNIDSQETRDVLAFVKKMVDDGIAYSQGGYLDGIFGQQKIMMYISTIAGRPYVEKSTKGKFTWSWAPVPTWVTNKVPFAGTDIIMFNTASEEEKKAAWEFMKYLISPEVTAYWAINTGYIPVRRSALETSIWKEAAKSDPLLEIPLKQIDNAVFDPQIGVWYEIRTVVGNMFSDFINGKVDMETAIKTADQKIRE

SEQ ID NO: 161 - protein, 438 aa, Artificial
  Substituion in SEQ ID NO 154
MKHKNKALMATATAVVMCAWMATGCGDEETGGGGGIPMTKSSNASGQAASTAQPVTITFEESMPGKLGTELQKLTNEFEKQNPNIHVQLIFNGSYSTLEQKLTAAIASGTEPTVAQVEETWETNYVQNGLIEPLDSVIPKSTQNDLIPIWRQDSTYNGRLMSVPFNKSAYVLYYNVDDLKKAGISSPPTTWSQLEQDAIKIQKKEGIPGLGLQGNYYTFEMLLKQAGGQILNARNTKAAFDSSAGLAALHFMKRLVDEHAAKVIGANEYLSDGFNTNEYAMDLDTVAAMSFINNSNLHWKVAPLPKGVTYAVPTAGLNLVIFNAATSAQKAAAAKYLNFLISVPSTIEWAEQTGYLPVRQSALTNSAWTSFIKTHPNQGVAPNELKYAYFSPRLASLYSAEQEMTTQIGNMLAGRQTPQVTLQNMANITNQALAQGNS

SEQ ID NO: 162 - protein, 438 aa, Artificial
  Substituion in SEQ ID NO 154
MKHKNKALMATATAVVMCAWMATGCGDEETGGGGGIPMTKSSNASGQAASTAQPVTITFEESMPGKLGTELQKLTNEFEKQNPNIHVQLIFNGSYSTLEQKLTAAIASGTEPTVAQVEETWETNYVQNGLIEPLDSVIPKSTQNDLIPIWRQDSTYNGKLMSVPFNKSAYVLYYNVDDLKKAGISSPPTTWSQLEQDAIKIQKKEGIPGLGLQGNYYTFEMLLKQAGGQILNARNTKAAFDSSAGLAALHFMKRLVDEHAAKVIGANEYLSDGFNTNEYAMDLDTVAAMSFINNSNLHWKVAPLPKGVTYAVPTAGLNLVIFNAATSAQKAAAAKYLNFLISVPSTIEWAEQTGYLPVRQSALTNSAWTSFLKTHPNQGVAPNELKYAYFSPRLASLYSAEQEMTTQIGNMLAGRQTPQVTLQNMANITNQALAQGNS

SEQ ID NO: 163 - protein, 438 aa, Artificial
  Substituion in SEQ ID NO 154
MKHKNKALMATATAVVMCAWMATGCGDEETGGGGGIPMTKSSNASGQAASTAQPVTITFEESMPGKLGTELQKLTNEFEKQNPNIHVQLIFNGSYSTLEQKLTAAIASGTEPTVAQVEETWETNYVQNGLIEPLDSVIPKSTQNDLIPIWRQDSTYNGKLMSVPFNKSAYVLYYNVDDLKKAGISSPPTTWSQLEQDAIKIQKKEGIPGLGLQGNYYTFEMLLKQAGGQIINARNTKAAFDSSAGLAALHFMKRLVDEHAAKVIGANEYLSDGFNTNEYAMDLDTVAAMSFINNSNLHWKVAPLPKGVTYAVPTAGLNLVIFNAATSAQKAAAAKYLNFLISVPSTIEWAEQTGYLPVRQSALTNSAWTSFIKTHPNQGVAPNELKYAYFSPRLASLYSAEQEMTTQIGNMLAGRQTPQVTLQNMANITNQALAQGNS

SEQ ID NO: 164 - protein, 438 aa, Artificial
  Substituion in SEQ ID NO 154
MKHKNKALMATATAVVMCAWMATGCGDEETGGGGGIPMTKSSNASGQAASTAQPVTITFEESMPGKLGTELQKLTNEFEKQNPNIHVQLIFNGSYSTLEQKLTAAIASGTEPTVAQVEETWETNYVQNGLIEPLDSVIPKSTQNDLIPIWRQDSTYNGKLMSVPFNKSAYVLYYNVDDLKKAGISSPPTTWSQLEQDAIKIQKKEGIPGLGLQGNYYTFEMLLKQAGGQILNARNTKAAFDSSAGLAALHFMKRLVDEHAAKVIGANEYLSDGFNTNEYAMDLDTVAAMSFINNSNLHWKVAPLPKGVTYAVPTAGLNLVIFNAATSAQKAAAAKYLNFLISVPSTIEWAEQTGYLPVRQSALTNSAWTSFIKTHPNQGVAPNELKYAYFSPRLASLYSADQEMTTQIGNMLAGRQTPQVTLQNMANITNQALAQGNS

SEQ ID NO: 165 - protein, 438 aa, Artificial
  Substituion in SEQ ID NO 154
MKHKNKALMATATAIVMCAWMATGCGDEETGGGGGIPMTKSSNASGQAASTAQPVTITFEESMPGKLGTELQKLTNEFEKQNPNIHVQLIFNGSYSTLEQKLTAAIASGTEPTVAQVEETWETNYVQNGLIEPLDSVIPKSTQNDLIPIWRQDSTYNGKLMSVPFNKSAYVLYYNVDDLKKAGISSPPTTWSQLEQDAIKIQKKEGIPGLGLQGNYYTFEMLLKQAGGQILNARNTKAAFDSSAGLAALHFMKRLVDEHAAKVIGANEYLSDGFNTNEYAMDLDTVAAMSFINNSNLHWKVAPLPKGVTYAVPTAGLNLVIFNAATSAQKAAAAKYLNFLISVPSTIEWAEQTGYLPVRQSALTNSAWTSFIKTHPNQGVAPNELKYAYFSPRLASLYSAEQEMTTQIGNMLAGRQTPQVTLQNMANITNQALAQGNS

SEQ ID NO: 166 - DNA, 1317 bp, Artificial
  Substituion in SEQ ID NO 155
gtgaaacacaaaaacaaggccctcatggcgacagccacagcggtggtgatgtgcgcgtggatggccactggatgcggagacgaggagaccggcggcgggggcggaatccccatgaccaagtcctccaacgcatcgggacaagccgcgagcaccgcgcaacctgtgaccatcacctttgaggaatccatgcctggcaagctcgggaccgaactccaaaagctgacgaacgagtttgagaagcaaaatcccaacatccacgtgcagctcatcttcaatggctcgtacagcacgttggagcagaagttgaccgccgccattgcgtccggcacagagcccacggtggcgcaggtcgaggagacgtgggagacgaattacgtgcagaacggtctgattgagcccctcgactccgtcattccgaaatccacgcagaacgatctaatcccgatttggcgtcaggactcgacgtacaacggccgtttgatgtccgttcccttcaacaagtccgcctacgtcctgtactacaatgtggacgatttaaagaaggccgggatttcttcgccgccgacaacctggagccagctcgaacaggatgccatcaagattcaaaagaaagaaggcattccgggcctcggcctgcagggcaactattacacctttgaaatgctcttaaaacaagcgggtggacagatcctgaacgccagaaacaccaaggcggccttcgatagctcagccggtctcgcagcgctccatttcatgaagcgcttggtggatgaacacgcggccaaggtcatcggcgcgaacgaatacctctccgacggtttcaacacgaacgagtacgcgatggacctcgacacggtcgccgcgatgtcgttcatcaacaactcgaacctccattggaaagttgcgccgctcccaaagggcgtgacctacgccgtccccacggccggtttgaacttggtcattttcaacgcagcgacatccgctcagaaagcggcggcggcgaagtatctgaacttcctcatttctgtaccatcgaccatcgagtgggcggaacagacaggctacctccccgtccgccaaagcgcactcaccaattcggcctggacgagcttcatcaagacccatccgaatcagggggtcgcacccaacgagctgaaatacgcctatttctcccctcggctcgcttcgctctactccgcggagcaagagatgaccacacagattggcaacatgctggcgggtcggcagacgccgcaggtgaccctgcagaacatggcgaacatcacgaaccaagcgctcgcccagggcaattcatga

SEQ ID NO: 167 - DNA, 1317 bp, Artificial
  Substituion in SEQ ID NO 155
gtgaaacacaaaaacaaggccctcatggcgacagccacagcggtggtgatgtgcgcgtggatggccactggatgcggagacgaggagaccggcggcgggggcggaatccccatgaccaagtcctccaacgcatcgggacaagccgcgagcaccgcgcaacctgtgaccatcacctttgaggaatccatgcctggcaagctcgggaccgaactccaaaagctgacgaacgagtttgagaagcaaaatcccaacatccacgtgcagctcatcttcaatggctcgtacagcacgttggagcagaagttgaccgccgccattgcgtccggcacagagcccacggtggcgcaggtcgaggagacgtgggagacgaattacgtgcagaacggtctgattgagcccctcgactccgtcattccgaaatccacgcagaacgatctaatcccgatttggcgtcaggactcgacgtacaacggcaagttgatgtccgttcccttcaacaagtccgcctacgtcctgtactacaatgtggacgatttaaagaaggccgggatttcttcgccgccgacaacctggagccagctcgaacaggatgccatcaagattcaaaagaaagaaggcattccgggcctcggcctgcagggcaactattacacctttgaaatgctcttaaaacaagcgggtggacagatcctgaacgccagaaacaccaaggcggccttcgatagctcagccggtctcgcagcgctccatttcatgaagcgcttggtggatgaacacgcggccaaggtcatcggcgcgaacgaatacctctccgacggtttcaacacgaacgagtacgcgatggacctcgacacggtcgccgcgatgtcgttcatcaacaactcgaacctccattggaaagttgcgccgctcccaaagggcgtgacctacgccgtccccacggccggtttgaacttggtcattttcaacgcagcgacatccgctcagaaagcggcggcggcgaagtatctgaacttcctcatttctgtaccatcgaccatcgagtgggcggaacagacaggctacctccccgtccgccaaagcgcactcaccaattcggcctggacgagcttcttaaagacccatccgaatcagggggtcgcacccaacgagctgaaatacgcctatttctcccctcggctcgcttcgctctactccgcggagcaagagatgaccacacagattggcaacatgctggcgggtcggcagacgccgcaggtgaccctgcagaacatggcgaacatcacgaaccaagcgctcgcccagggcaattcatga

SEQ ID NO: 168 - DNA, 1317 bp, Artificial
  Substituion in SEQ ID NO 155
gtgaaacacaaaaacaaggccctcatggcgacagccacagcggtggtgatgtgcgcgtggatggccactggatgcggagacgaggagaccggcggcgggggcggaatccccatgaccaagtcctccaacgcatcgggacaagccgcgagcaccgcgcaacctgtgaccatcacctttgaggaatccatgcctggcaagctcgggaccgaactccaaaagctgacgaacgagtttgagaagcaaaatcccaacatccacgtgcagctcatcttcaatggctcgtacagcacgttggagcagaagttgaccgccgccattgcgtccggcacagagcccacggtggcgcaggtcgaggagacgtgggagacgaattacgtgcagaacggtctgattgagcccctcgactccgtcattccgaaatccacgcagaacgatctaatcccgatttggcgtcaggactcgacgtacaacggcaagttgatgtccgttcccttcaacaagtccgcctacgtcctgtactacaatgtggacgatttaaagaaggccgggatttcttcgccgccgacaacctggagccagctcgaacaggatgccatcaagattcaaaagaaagaaggcattccgggcctcggcctgcagggcaactattacacctttgaaatgctcttaaaacaagcgggtggacagatcattaacgccagaaacaccaaggcggccttcgatagctcagccggtctcgcagcgctccatttcatgaagcgcttggtggatgaacacgcggccaaggtcatcggcgcgaacgaatacctctccgacggtttcaacacgaacgagtacgcgatggacctcgacacggtcgccgcgatgtcgttcatcaacaactcgaacctccattggaaagttgcgccgctcccaaagggcgtgacctacgccgtccccacggccggtttgaacttggtcattttcaacgcagcgacatccgctcagaaagcggcggcggcgaagtatctgaacttcctcatttctgtaccatcgaccatcgagtgggcggaacagacaggctacctccccgtccgccaaagcgcactcaccaattcggcctggacgagcttcatcaagacccatccgaatcagggggtcgcacccaacgagctgaaatacgcctatttctcccctcggctcgcttcgctctactccgcggagcaagagatgaccacacagattggcaacatgctggcgggtcggcagacgccgcaggtgaccctgcagaacatggcgaacatcacgaaccaagcgctcgcccagggcaattcatga

SEQ ID NO: 169 - DNA, 1317 bp, Artificial
  Substituion in SEQ ID NO 155
gtgaaacacaaaaacaaggccctcatggcgacagccacagcggtggtgatgtgcgcgtggatggccactggatgcggagacgaggagaccggcggcgggggcggaatccccatgaccaagtcctccaacgcatcgggacaagccgcgagcaccgcgcaacctgtgaccatcacctttgaggaatccatgcctggcaagctcgggaccgaactccaaaagctgacgaacgagtttgagaagcaaaatcccaacatccacgtgcagctcatcttcaatggctcgtacagcacgttggagcagaagttgaccgccgccattgcgtccggcacagagcccacggtggcgcaggtcgaggagacgtgggagacgaattacgtgcagaacggtctgattgagcccctcgactccgtcattccgaaatccacgcagaacgatctaatcccgatttggcgtcaggactcgacgtacaacggcaagttgatgtccgttcccttcaacaagtccgcctacgtcctgtactacaatgtggacgatttaaagaaggccgggatttcttcgccgccgacaacctggagccagctcgaacaggatgccatcaagattcaaaagaaagaaggcattccgggcctcggcctgcagggcaactattacacctttgaaatgctcttaaaacaagcgggtggacagatcctgaacgccagaaacaccaaggcggccttcgatagctcagccggtctcgcagcgctccatttcatgaagcgcttggtggatgaacacgcggccaaggtcatcggcgcgaacgaatacctctccgacggtttcaacacgaacgagtacgcgatggacctcgacacggtcgccgcgatgtcgttcatcaacaactcgaacctccattggaaagttgcgccgctcccaaagggcgtgacctacgccgtccccacggccggtttgaacttggtcattttcaacgcagcgacatccgctcagaaagcggcggcggcgaagtatctgaacttcctcatttctgtaccatcgaccatcgagtgggcggaacagacaggctacctccccgtccgccaaagcgcactcaccaattcggcctggacgagcttcatcaagacccatccgaatcagggggtcgcacccaacgagctgaaatacgcctatttctcccctcggctcgcttcgctctactccgcggatcaagagatgaccacacagattggcaacatgctggcgggtcggcagacgccgcaggtgaccctgcagaacatggcgaacatcacgaaccaagcgctcgcccagggcaattcatga

SEQ ID NO: 170 - DNA, 1317 bp, Artificial
  Substituion in SEQ ID NO 155
gtgaaacacaaaaacaaggccctcatggcgacagccacagcgattgtgatgtgcgcgtggatggccactggatgcggagacgaggagaccggcggcgggggcggaatccccatgaccaagtcctccaacgcatcgggacaagccgcgagcaccgcgcaacctgtgaccatcacctttgaggaatccatgcctggcaagctcgggaccgaactccaaaagctgacgaacgagtttgagaagcaaaatcccaacatccacgtgcagctcatcttcaatggctcgtacagcacgttggagcagaagttgaccgccgccattgcgtccggcacagagcccacggtggcgcaggtcgaggagacgtgggagacgaattacgtgcagaacggtctgattgagcccctcgactccgtcattccgaaatccacgcagaacgatctaatcccgatttggcgtcaggactcgacgtacaacggcaagttgatgtccgttcccttcaacaagtccgcctacgtcctgtactacaatgtggacgatttaaagaaggccgggatttcttcgccgccgacaacctggagccagctcgaacaggatgccatcaagattcaaaagaaagaaggcattccgggcctcggcctgcagggcaactattacacctttgaaatgctcttaaaacaagcgggtggacagatcctgaacgccagaaacaccaaggcggccttcgatagctcagccggtctcgcagcgctccatttcatgaagcgcttggtggatgaacacgcggccaaggtcatcggcgcgaacgaatacctctccgacggtttcaacacgaacgagtacgcgatggacctcgacacggtcgccgcgatgtcgttcatcaacaactcgaacctccattggaaagttgcgccgctcccaaagggcgtgacctacgccgtccccacggccggtttgaacttggtcattttcaacgcagcgacatccgctcagaaagcggcggcggcgaagtatctgaacttcctcatttctgtaccatcgaccatcgagtgggcggaacagacaggctacctccccgtccgccaaagcgcactcaccaattcggcctggacgagcttcatcaagacccatccgaatcagggggtcgcacccaacgagctgaaatacgcctatttctcccctcggctcgcttcgctctactccgcggagcaagagatgaccacacagattggcaacatgctggcgggtcggcagacgccgcaggtgaccctgcagaacatggcgaacatcacgaaccaagcgctcgcccagggcaattcatga

SEQ ID NO: 171 - protein, 466 aa, Alicyclobacillus acidocaldarius
MMQAEVAQAEYRPNLGYVVTVVVIASLGGLLFGYDTGVIAGANEFLKSEFHMSAATTGLVSSSIDLGAMLGVLIAGFLGDSFGRKKALSVAGIIFIASSLISAFAPSVGVLVLGRFIGGVGIGLASLLSPLYIAEIAPPRIRGRLVGSNQLAIVSGIFIVYFVNAAIVSSHTTAWNQTTGWRWMFAMGVIPAVIFFFLLFLVPESPRYLMKRGREEQAISILERVSGPERARWDVEEIRKSLEVVPDSLFQELSRPGIRKALGIGVVLAIFQQFTGTNAVGYYAPMIFKAAGAGTNASFYDTVWIGAIKVIFVIVLMLIVDRVGRKRLLVWNGMLMALFLAILGVAFSLPHMITWLVLALVFAHTIAYELSWGGGVWIVLSEIYPTAIRGRAMAIASFALWFATYLVAQFFPILLQAIGGTWTFWIFALFCIAMAVFMQRVVPETSKKTMEKIQSDWLQSERGSSL

SEQ ID NO: 172 - DNA, 1401 bp, Alicyclobacillus acidocaldarius
ttgatgcaggcagaagtggcgcaggccgagtatcggccgaatctgggctacgtcgtgacggtcgtcgtcattgcatcgctcggcgggcttctcttcgggtatgacaccggcgtgatcgcaggggcgaacgagtttctgaaatcggagtttcacatgagtgcagcgaccaccggactcgtctcgagcagcatcgatctcggcgccatgctcggcgtgctcatcgcgggcttcctgggcgactcgttcggaaggaagaaagcgctgtcggtcgcgggcatcatcttcatcgcctcgagcttgatctcggccttcgcgccgagcgtcggcgtgttggttctcgggcggtttatcgggggcgtcggcatcggtctggcgtcgctgttgtcgccgctctacatcgccgagatcgcaccgccgcggatccgcgggcgattggtcgggtcgaaccaattggctatcgtgtccgggattttcatcgtctactttgtgaacgcggctatcgtcagttcgcacaccacggcctggaaccagacgacgggctggcgctggatgtttgccatgggtgtcattccggccgtcatctttttcttcctgctcttccttgtgccggagagcccgaggtatctcatgaagcggggacgcgaagagcaggccatctcgattctcgaacgcgtgagcggccctgagcgggcgcggtgggacgtcgaggagattcgcaaatcgctcgaagtcgtgccggattcgttgtttcaagaactgtcgcgcccgggcattcgaaaggcgctcggcatcggcgtcgtgctcgcgatcttccaacagttcacgggcaccaacgccgtgggctattacgccccgatgatcttcaaggcggccggcgcaggcaccaacgcgtcgttctacgacacggtttggattggcgccatcaaggtcatcttcgtcatcgtgctgatgctcatcgtcgatcgcgtcggaagaaagcggttgcttgtgtggaacgggatgctcatggcgctctttctcgccatcctgggcgtcgccttttcactgccgcacatgatcacgtggctggtcctcgcgcttgtgttcgcgcacaccatcgcctacgagctgtcctggggcggcggcgtgtggattgtgttgtccgagatctatccgactgccatccgcggccgcgccatggccatcgcgtcctttgcgctgtggttcgccacatacctcgtggcgcagttcttcccgattttgttgcaggctatcggcggcacgtggacgttttggatcttcgcgctgttctgcatcgccatggccgtcttcatgcagcgggtcgtgccggagacgagcaagaagacgatggagaagatccaaagcgactggctccagtcggagcgaggaagctctctgtga

SEQ ID NO: 173 - protein, 441 aa, Pediococcus pentosaceus ATCC 25745
YVILISCAAALGGLLFGYDTAVISGAVGFLQIKFTLSSAQVGWVTSCILIGCALGVSIAGILSDLFGRKKILALSAVIFALSSLGAAFAGSYMILVIWRMLAGIGIGLTSLITPLYIAEMAPSNVRGKLVSVNQLAITIGIFIVYFVNAAIASNATQLWNVSTGWRWMMGVGVIPSLLFLIALIPAGESPRWLSQHGKSEAAYKVLQKVEISDEAAEKSLEEIQMSEEVVDDTKFRDLFNKTWLPVLIIGVLLALFQQFSGSNAIMYYAPEIFKGAGFGQSGAFMATVSIGVINMVITIVALGLVDKIGRKKLLGWGSFAMSCCLLVVSICFFVHAATSITLTFVLLAIAAYAVSLAPVTWILISEIFPLKIRGRAMSICTAVLWLSDFTLSYTFPILTQNIGEGWTFMLYVVVTALSAIFVWKLVPETRGKSLEEIEVYW

SEQ ID NO: 174 - protein, 446 aa, Bacillus subtilis subsp. subtilis str. 168
SMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 175 - protein, 443 aa, Bacillus amyloliquefaciens FZB42
FVILISCAAGLGGLLYGYDTAVISGAIGFLKDLYRLSPFMEGLVISSIMIGGVFGVGISGFLSDRFGRRKILMAAALLFAVSAVVSALSQSVSSLVIARVIGGLGIGMGSSLSVTYITEAAPPAIRGSLSSLYQLFTILGISGTYFINLAVQQSGSYEWGVHTGWRWMLAYGMIPSVIFFIVLLIVPESPRWLAKAGRRNEALAVLTRINGEQTAKEEIKQIETSLQLEKMGSLSQLFKPGLRKALVIGILLALFNQVIGMNAITYYGPEIFKMMGFGQNAGFITTCIVGVVEVIFTIIAVLLVDKVGRKKLMGVGSAFMALFMILIGASFYFQLASGPALVVIILGFVAAFCVSVGPITWIMISEIFPNHLRARAAGIATIFLWGANWAIGQFVPMMISGLGLAYTFWIFAVINILCFLFVVTICPETKNKSLEEIEKLWIK

SEQ ID NO: 176 - protein, 460 aa, Clostridium acetobutylicum ATCC 824
HKHSLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSKQNAKGSSV

SEQ ID NO: 177 - protein, 452 aa, Bacillus cereus ATCC 10987
YIFSITLVAAIGGLLFGYDTAVISGAEESLKVYFIDSLGLGSLAHGVTVSSALIGCIIGGVISGYCASKFGRKRSLIIAAILFIVSALGASYPEFLFFTKGEPTIVLLLAFNLYRIIGGIGVGLASAICPIYIGEIAPADIRGRLVSFNQFMIIFGMLVVYFVNWGIANGETLEWINDVGWRYMFASGVIPAIIFAILLLFVPETPRYLAIQHQDKKALAILTKINGPLEAKAILDDIKQTMAINVSSEKLFSYGKLVIIVGVLLSVFQQFVGINVALYYAPRIFESMGAAKDSSMMQTIIMGLVNVIFTVIAILTVDRWGRKPLLIVGSIGMAIGMFGVASMAFANIIGIGTLIFIIVYTASFMMSWGPICWVLISEIFPNKIRGQAVAIAVAAQWAANYFISSTYPMMMEYSGGLTYSFYGLMSVLSALFVWKLVPETKGKTLEQMENTW

SEQ ID NO: 178 - protein, 466 aa, Artificial
  Substituion in SEQ ID NO 171
MMQAEVAQAEYRPNLGYVVTVVVIASIGGLLFGYDTGVIAGANEFLKSEFHMSAATTGLVSSSIDLGAMLGVLIAGFLGDSFGRKKALSVAGIIFIASSLISAFAPSVGVLVLGRFIGGVGIGLASLLSPLYIAEIAPPRIRGRLVGSNQLAIVSGIFIVYFVNAAIVSSHTTAWNQTTGWRWMFAMGVIPAVIFFFLLFLVPESPRYLMKRGREEQAISILERVSGPERARWDVEEIRKSLEVVPDSLFQELSRPGIRKALGIGVVLAIFQQFTGTNAVGYYAPMIFKAAGAGTNASFYDTVWIGAIKVIFVIVLMLIVDRVGRKRLLVWNGMLMALFLAILGVAFSLPHMITWLVLALVFAHTIAYELSWGGGVWIVLSEIYPTAIRGRAMAIASFALWFATYLVAQFFPILLQAIGGTWTFWIFALFCIAMAVFMQRVVPETSKKTMEKIQSDWLQSERGSSL

SEQ ID NO: 179 - protein, 466 aa, Artificial
  Substituion in SEQ ID NO 171
MMQAEVAQAEYRPNLGYVVTVIVIASLGGLLFGYDTGVIAGANEFLKSEFHMSAATTGLVSSSIDLGAMLGVLIAGFLGDSFGRKKALSVAGIIFIASSLISAFAPSVGVLVLGRFIGGVGIGLASLLSPLYIAEIAPPRIRGRLVGSNQLAIVSGIFIVYFVNAAIVSSHTTAWNQTTGWRWMFAMGVIPAVIFFFLLFLVPESPRYLMKRGREEQAISILERVSGPERARWDVEEIRKSLEVVPDSLFQELSRPGIRKALGIGVVLAIFQQFTGTNAVGYYAPMIFKAAGAGTNASFYDTVWIGAIKVIFVIVLMLIVDRVGRKRLLVWNGMLMALFLAILGVAFSLPHMITWLVLALVFAHTIAYELSWGGGVWIVLSEIYPTAIRGRAMAIASFALWFATYLVAQFFPILLQAIGGTWTFWIFALFCIAMAVFMQRVVPETSKKTMEKIQSDWLQSERGSSL

SEQ ID NO: 180 - protein, 466 aa, Artificial
  Substituion in SEQ ID NO 171
MMQAEVAQAEYRPNLGYVVTVVVIASLGGLLFGYDTGVIAGANEFLKSEFHMSAATTGLVSSSIDLGAMLGVLIAGFLGDSFGRKKALSVAGIIFIASSLISAFAPSVGVLVLGRFIGGVGIGLASLLSPLYIAEIAPPRIRGRLVGSNQLAIVSGIFIVYFVNAAIVSSHTTAWNQTTGWRWMFAMGVIPAVIFFFLLFLVPESPRYLMKRGREEQAISILERVSGPERARWDVEEIRKSLEVVPDSLFQELSRPGIRKALGIGVVLAIFQQFTGTNAVGYYAPMIFKAAGAGTNASFYDTVWIGAIKVIFVLVLMLIVDRVGRKRLLVWNGMLMALFLAILGVAFSLPHMITWLVLALVFAHTIAYELSWGGGVWIVLSEIYPTAIRGRAMAIASFALWFATYLVAQFFPILLQAIGGTWTFWIFALFCIAMAVFMQRVVPETSKKTMEKIQSDWLQSERGSSL

SEQ ID NO: 181 - protein, 466 aa, Artificial
  Substituion in SEQ ID NO 171
MMQAEVAQAEYRPNLGYVVTVVVIASLGGLLFGYDTGVIAGANEFLKSEFHMSAATTGLVSSSIDLGAMLGVLIAGFLGDSFGRKKALSVAGIIFIASSLISAFAPSVGVLVLGRFIGGVGIGLASLLSPLYIAEIAPPRIRGRLVGSNQLAIVSGIFIVYFVNAAIVSSHTTAWNQTTGWRWMFAMGVIPAVIFFFLLFLVPESPRYLMKRGREEQAISILERVSGPERARWDVEEIRKSLEVVPDSLFQELSRPGLRKALGIGVVLAIFQQFTGTNAVGYYAPMIFKAAGAGTNASFYDTVWIGAIKVIFVIVLMLIVDRVGRKRLLVWNGMLMALFLAILGVAFSLPHMITWLVLALVFAHTIAYELSWGGGVWIVLSEIYPTAIRGRAMAIASFALWFATYLVAQFFPILLQAIGGTWTFWIFALFCIAMAVFMQRVVPETSKKTMEKIQSDWLQSERGSSL

SEQ ID NO: 182 - protein, 466 aa, Artificial
  Substituion in SEQ ID NO 171
MMQAEVAQAEYRPNLGYVVTVVVIASLGGLLFGYDTGVIAGANEFLKSEFHMSAATTGLVSSSIDLGAMLGVLIAGFLGDSFGRKKALSVAGIIFIASSLISAFAPSVGVLVLGRFIGGVGIGLASLLSPLYIAEIAPPRIRGRLVGSNQLAIVSGIFIVYFVNAAIVSSHTTAWNQTTGWRWMFAMGVIPAVIFFFLLFLVPESPRYLMKRGREEQAISILERVSGPERARWDVEEIRKSLEVVPDSLFQELSRPGIRKALGIGVILAIFQQFTGTNAVGYYAPMIFKAAGAGTNASFYDTVWIGAIKVIFVIVLMLIVDRVGRKRLLVWNGMLMALFLAILGVAFSLPHMITWLVLALVFAHTIAYELSWGGGVWIVLSEIYPTAIRGRAMAIASFALWFATYLVAQFFPILLQAIGGTWTFWIFALFCIAMAVFMQRVVPETSKKTMEKIQSDWLQSERGSSL

SEQ ID NO: 183 - DNA, 1401 bp, Artificial
  Substituion in SEQ ID NO 172
ttgatgcaggcagaagtggcgcaggccgagtatcggccgaatctgggctacgtcgtgacggtcgtcgtcattgcatcgattggcgggcttctcttcgggtatgacaccggcgtgatcgcaggggcgaacgagtttctgaaatcggagtttcacatgagtgcagcgaccaccggactcgtctcgagcagcatcgatctcggcgccatgctcggcgtgctcatcgcgggcttcctgggcgactcgttcggaaggaagaaagcgctgtcggtcgcgggcatcatcttcatcgcctcgagcttgatctcggccttcgcgccgagcgtcggcgtgttggttctcgggcggtttatcgggggcgtcggcatcggtctggcgtcgctgttgtcgccgctctacatcgccgagatcgcaccgccgcggatccgcgggcgattggtcgggtcgaaccaattggctatcgtgtccgggattttcatcgtctactttgtgaacgcggctatcgtcagttcgcacaccacggcctggaaccagacgacgggctggcgctggatgtttgccatgggtgtcattccggccgtcatctttttcttcctgctcttccttgtgccggagagcccgaggtatctcatgaagcggggacgcgaagagcaggccatctcgattctcgaacgcgtgagcggccctgagcgggcgcggtgggacgtcgaggagattcgcaaatcgctcgaagtcgtgccggattcgttgtttcaagaactgtcgcgcccgggcattcgaaaggcgctcggcatcggcgtcgtgctcgcgatcttccaacagttcacgggcaccaacgccgtgggctattacgccccgatgatcttcaaggcggccggcgcaggcaccaacgcgtcgttctacgacacggtttggattggcgccatcaaggtcatcttcgtcatcgtgctgatgctcatcgtcgatcgcgtcggaagaaagcggttgcttgtgtggaacgggatgctcatggcgctctttctcgccatcctgggcgtcgccttttcactgccgcacatgatcacgtggctggtcctcgcgcttgtgttcgcgcacaccatcgcctacgagctgtcctggggcggcggcgtgtggattgtgttgtccgagatctatccgactgccatccgcggccgcgccatggccatcgcgtcctttgcgctgtggttcgccacatacctcgtggcgcagttcttcccgattttgttgcaggctatcggcggcacgtggacgttttggatcttcgcgctgttctgcatcgccatggccgtcttcatgcagcgggtcgtgccggagacgagcaagaagacgatggagaagatccaaagcgactggctccagtcggagcgaggaagctctctgtga

SEQ ID NO: 184 - DNA, 1401 bp, Artificial
  Substituion in SEQ ID NO 172
ttgatgcaggcagaagtggcgcaggccgagtatcggccgaatctgggctacgtcgtgacggtcattgtcattgcatcgctcggcgggcttctcttcgggtatgacaccggcgtgatcgcaggggcgaacgagtttctgaaatcggagtttcacatgagtgcagcgaccaccggactcgtctcgagcagcatcgatctcggcgccatgctcggcgtgctcatcgcgggcttcctgggcgactcgttcggaaggaagaaagcgctgtcggtcgcgggcatcatcttcatcgcctcgagcttgatctcggccttcgcgccgagcgtcggcgtgttggttctcgggcggtttatcgggggcgtcggcatcggtctggcgtcgctgttgtcgccgctctacatcgccgagatcgcaccgccgcggatccgcgggcgattggtcgggtcgaaccaattggctatcgtgtccgggattttcatcgtctactttgtgaacgcggctatcgtcagttcgcacaccacggcctggaaccagacgacgggctggcgctggatgtttgccatgggtgtcattccggccgtcatctttttcttcctgctcttccttgtgccggagagcccgaggtatctcatgaagcggggacgcgaagagcaggccatctcgattctcgaacgcgtgagcggccctgagcgggcgcggtgggacgtcgaggagattcgcaaatcgctcgaagtcgtgccggattcgttgtttcaagaactgtcgcgcccgggcattcgaaaggcgctcggcatcggcgtcgtgctcgcgatcttccaacagttcacgggcaccaacgccgtgggctattacgccccgatgatcttcaaggcggccggcgcaggcaccaacgcgtcgttctacgacacggtttggattggcgccatcaaggtcatcttcgtcatcgtgctgatgctcatcgtcgatcgcgtcggaagaaagcggttgcttgtgtggaacgggatgctcatggcgctctttctcgccatcctgggcgtcgccttttcactgccgcacatgatcacgtggctggtcctcgcgcttgtgttcgcgcacaccatcgcctacgagctgtcctggggcggcggcgtgtggattgtgttgtccgagatctatccgactgccatccgcggccgcgccatggccatcgcgtcctttgcgctgtggttcgccacatacctcgtggcgcagttcttcccgattttgttgcaggctatcggcggcacgtggacgttttggatcttcgcgctgttctgcatcgccatggccgtcttcatgcagcgggtcgtgccggagacgagcaagaagacgatggagaagatccaaagcgactggctccagtcggagcgaggaagctctctgtga

SEQ ID NO: 185 - DNA, 1401 bp, Artificial
  Substituion in SEQ ID NO 172
ttgatgcaggcagaagtggcgcaggccgagtatcggccgaatctgggctacgtcgtgacggtcgtcgtcattgcatcgctcggcgggcttctcttcgggtatgacaccggcgtgatcgcaggggcgaacgagtttctgaaatcggagtttcacatgagtgcagcgaccaccggactcgtctcgagcagcatcgatctcggcgccatgctcggcgtgctcatcgcgggcttcctgggcgactcgttcggaaggaagaaagcgctgtcggtcgcgggcatcatcttcatcgcctcgagcttgatctcggccttcgcgccgagcgtcggcgtgttggttctcgggcggtttatcgggggcgtcggcatcggtctggcgtcgctgttgtcgccgctctacatcgccgagatcgcaccgccgcggatccgcgggcgattggtcgggtcgaaccaattggctatcgtgtccgggattttcatcgtctactttgtgaacgcggctatcgtcagttcgcacaccacggcctggaaccagacgacgggctggcgctggatgtttgccatgggtgtcattccggccgtcatctttttcttcctgctcttccttgtgccggagagcccgaggtatctcatgaagcggggacgcgaagagcaggccatctcgattctcgaacgcgtgagcggccctgagcgggcgcggtgggacgtcgaggagattcgcaaatcgctcgaagtcgtgccggattcgttgtttcaagaactgtcgcgcccgggcattcgaaaggcgctcggcatcggcgtcgtgctcgcgatcttccaacagttcacgggcaccaacgccgtgggctattacgccccgatgatcttcaaggcggccggcgcaggcaccaacgcgtcgttctacgacacggtttggattggcgccatcaaggtcatcttcgtcttagtgctgatgctcatcgtcgatcgcgtcggaagaaagcggttgcttgtgtggaacgggatgctcatggcgctctttctcgccatcctgggcgtcgccttttcactgccgcacatgatcacgtggctggtcctcgcgcttgtgttcgcgcacaccatcgcctacgagctgtcctggggcggcggcgtgtggattgtgttgtccgagatctatccgactgccatccgcggccgcgccatggccatcgcgtcctttgcgctgtggttcgccacatacctcgtggcgcagttcttcccgattttgttgcaggctatcggcggcacgtggacgttttggatcttcgcgctgttctgcatcgccatggccgtcttcatgcagcgggtcgtgccggagacgagcaagaagacgatggagaagatccaaagcgactggctccagtcggagcgaggaagctctctgtga

SEQ ID NO: 186 - DNA, 1401 bp, Artificial
  Substituion in SEQ ID NO 172
ttgatgcaggcagaagtggcgcaggccgagtatcggccgaatctgggctacgtcgtgacggtcgtcgtcattgcatcgctcggcgggcttctcttcgggtatgacaccggcgtgatcgcaggggcgaacgagtttctgaaatcggagtttcacatgagtgcagcgaccaccggactcgtctcgagcagcatcgatctcggcgccatgctcggcgtgctcatcgcgggcttcctgggcgactcgttcggaaggaagaaagcgctgtcggtcgcgggcatcatcttcatcgcctcgagcttgatctcggccttcgcgccgagcgtcggcgtgttggttctcgggcggtttatcgggggcgtcggcatcggtctggcgtcgctgttgtcgccgctctacatcgccgagatcgcaccgccgcggatccgcgggcgattggtcgggtcgaaccaattggctatcgtgtccgggattttcatcgtctactttgtgaacgcggctatcgtcagttcgcacaccacggcctggaaccagacgacgggctggcgctggatgtttgccatgggtgtcattccggccgtcatctttttcttcctgctcttccttgtgccggagagcccgaggtatctcatgaagcggggacgcgaagagcaggccatctcgattctcgaacgcgtgagcggccctgagcgggcgcggtgggacgtcgaggagattcgcaaatcgctcgaagtcgtgccggattcgttgtttcaagaactgtcgcgcccgggcttacgaaaggcgctcggcatcggcgtcgtgctcgcgatcttccaacagttcacgggcaccaacgccgtgggctattacgccccgatgatcttcaaggcggccggcgcaggcaccaacgcgtcgttctacgacacggtttggattggcgccatcaaggtcatcttcgtcatcgtgctgatgctcatcgtcgatcgcgtcggaagaaagcggttgcttgtgtggaacgggatgctcatggcgctctttctcgccatcctgggcgtcgccttttcactgccgcacatgatcacgtggctggtcctcgcgcttgtgttcgcgcacaccatcgcctacgagctgtcctggggcggcggcgtgtggattgtgttgtccgagatctatccgactgccatccgcggccgcgccatggccatcgcgtcctttgcgctgtggttcgccacatacctcgtggcgcagttcttcccgattttgttgcaggctatcggcggcacgtggacgttttggatcttcgcgctgttctgcatcgccatggccgtcttcatgcagcgggtcgtgccggagacgagcaagaagacgatggagaagatccaaagcgactggctccagtcggagcgaggaagctctctgtga

SEQ ID NO: 187 - DNA, 1401 bp, Artificial
  Substituion in SEQ ID NO 172
ttgatgcaggcagaagtggcgcaggccgagtatcggccgaatctgggctacgtcgtgacggtcgtcgtcattgcatcgctcggcgggcttctcttcgggtatgacaccggcgtgatcgcaggggcgaacgagtttctgaaatcggagtttcacatgagtgcagcgaccaccggactcgtctcgagcagcatcgatctcggcgccatgctcggcgtgctcatcgcgggcttcctgggcgactcgttcggaaggaagaaagcgctgtcggtcgcgggcatcatcttcatcgcctcgagcttgatctcggccttcgcgccgagcgtcggcgtgttggttctcgggcggtttatcgggggcgtcggcatcggtctggcgtcgctgttgtcgccgctctacatcgccgagatcgcaccgccgcggatccgcgggcgattggtcgggtcgaaccaattggctatcgtgtccgggattttcatcgtctactttgtgaacgcggctatcgtcagttcgcacaccacggcctggaaccagacgacgggctggcgctggatgtttgccatgggtgtcattccggccgtcatctttttcttcctgctcttccttgtgccggagagcccgaggtatctcatgaagcggggacgcgaagagcaggccatctcgattctcgaacgcgtgagcggccctgagcgggcgcggtgggacgtcgaggagattcgcaaatcgctcgaagtcgtgccggattcgttgtttcaagaactgtcgcgcccgggcattcgaaaggcgctcggcatcggcgtcattctcgcgatcttccaacagttcacgggcaccaacgccgtgggctattacgccccgatgatcttcaaggcggccggcgcaggcaccaacgcgtcgttctacgacacggtttggattggcgccatcaaggtcatcttcgtcatcgtgctgatgctcatcgtcgatcgcgtcggaagaaagcggttgcttgtgtggaacgggatgctcatggcgctctttctcgccatcctgggcgtcgccttttcactgccgcacatgatcacgtggctggtcctcgcgcttgtgttcgcgcacaccatcgcctacgagctgtcctggggcggcggcgtgtggattgtgttgtccgagatctatccgactgccatccgcggccgcgccatggccatcgcgtcctttgcgctgtggttcgccacatacctcgtggcgcagttcttcccgattttgttgcaggctatcggcggcacgtggacgttttggatcttcgcgctgttctgcatcgccatggccgtcttcatgcagcgggtcgtgccggagacgagcaagaagacgatggagaagatccaaagcgactggctccagtcggagcgaggaagctctctgtga

SEQ ID NO: 188 - protein, 446 aa, Alicyclobacillus acidocaldarius
MEAKPMKRDRLWKSGALLALGLVATGCGAPAANGGGQAATGASRAAASSQPVTITFWYGVGTTLSQDIQQMVQAFNQTHPGIKVVATYQGSYSGGGEEQQKLLAAIKAGDPPTIAQIEVHAMPVFAASGQLLDLTNLMQSSSVDKPSNFLPGILVSTQYQGRYYAVPFNRSVPVLYYNKTLFAKAHIASPPSNWAQLAADAKKLTSGAGSNKIYGFEPLVDWWPWEYAVESGGGSILSPDLKRATFDQPPALSILETEQSLVKQGYAKVETGPNYWDLMTQDFINGQVAMDIDSIGSAGKVTKGVGDKFQWGTALLPRGKTLAVPPGGGDLAIFKDATPAQQKAAWTFIQWWTAPKQSVQWSTETGYLPVQKADLNDPVYQAYLEKHPQYRTAIEELQYEHPSPASPAYLAVLQPVQQALQGIFDEGKPVAATMHQAAEAADQNLG

SEQ ID NO: 189 - DNA, 1341 bp, Alicyclobacillus acidocaldarius
ttggaggcgaaacccatgaagcgagatcgactgtggaaatccggcgcgctcctggcgctcggacttgtggcgacgggatgcggtgcgcccgccgcaaacggcggcggacaggcggcgaccggcgccagccgggccgcggcatcgagccagcccgtgaccatcaccttctggtacggcgtcggcacgacgctcagccaggacattcagcagatggtgcaggcgttcaaccagacccaccccggcatcaaggtcgtggcgacctatcaaggcagctactccggcggcggcgaggaacagcagaagctgctcgcggccatcaaggcgggcgatccgcccaccatcgcacaaattgaggtgcacgcgatgccggttttcgcggcgagcgggcaattgctcgacctcaccaacctgatgcagtcttcgagcgtcgacaagccgtccaacttcctgccgggcatcctcgtctcgacccagtaccagggccgatactacgcggtgcccttcaaccgcagcgtgcccgtgctctactacaacaagacgctcttcgcgaaggcgcacatcgcctcgcccccctcgaactgggcgcagctcgcggcggacgcgaagaagctcacgagcggggccggatcgaacaagatctacggtttcgaaccgctcgtcgactggtggccgtgggaatacgcggtggagtcaggcggcggctccatcctgtcgcccgatttgaagcgcgccaccttcgaccagccgcccgcgctctccatcctcgagacggagcagtcgctcgtgaagcagggatacgccaaggtcgagacgggaccgaactactgggacctcatgacgcaggacttcatcaacggccaagtggccatggacatcgactccatcggcagcgcgggcaaggtgacgaagggcgtgggcgacaagttccagtggggcaccgcgctcctgccgcgcggcaagacgctcgccgtcccgccgggcggtggcgatctcgccatcttcaaggacgccacgcccgcgcaacagaaggccgcgtggacgttcatccagtggtggaccgcgcccaagcagtcggtccaatggtccaccgagaccggttacctgcccgtgcagaaggcggatctgaacgaccccgtctaccaggcgtacctcgagaagcacccgcagtaccggaccgccattgaggagctccagtacgagcatccgtcgccggcgtcccccgcgtacctggccgtgctgcagccggtgcaacaggcgctgcaaggcatcttcgacgagggcaagcccgtcgcggccacgatgcatcaggccgcagaggccgccgatcaaaacctcggatga

SEQ ID NO: 190 - protein, 349 aa, Clostridium difficile 630
IDFWAPLGGTNGETAQKMVDQFNSEHKDVQVNMLKQKDYYENATKLQAALTSKDQPDVTLLEITQTGTFASAGALVDMSKYFDKTYQERFFSGLLTNSYYEDKFVGMPFNRSTPILYINKDMATKAGLDPSGPKSWEELKDYASKMTNKSEDTYGFETPIDIWFYEAMVMQSGGEITNGKKVAFNNEAGQAPVKFWQDMMKAGIMKMPPGEDYNAWDVAKQDFVNGKVGMIFTSTADLAGLMQQTEGKFEISTAFLPKNQKYATPTGGANLVMLEGGTDKEKEASAEFIEWMTQTDKIVQFSSSTGYLPTTEDATNSEKLQTLYKEKPQYKVATDQLQYAVALPMLNGY

SEQ ID NO: 191 - protein, 349 aa, Clostridium difficile QCD-32g58
IDFWAPLGGTNGETAQKMVDQFNSEHKDVQVNMLKQKDYYENATKLQAALTSKDQPDVTLLEITQTGTFASAGALVDMSKYFDKTYQERFFSGLLTNSYYEDKFVGMPFNRSTPILYINRDMATKAGLDPSGPKSWEELKDYASKMTNKSEDTYGFETPIDIWFYEAMVMQSGGEITNGKKVAFNNEAGQAPVKFWQDMMKAGIMKMPPGEDYNAWDVAKQDFVNGKVGMIFTSTADLAGLMQQTEGKFEISTAFLPKNQKYATPTGGANLVMLEGGTDKEKEASAEFIEWMTQTDKIVQFSSSTGYLPTTEDATNSEKLQTLYKEKPQYKVATDQLQYAVALPMLNGY

SEQ ID NO: 192 - protein, 390 aa, Bacillus sp. NRRL B-14911
IHIKYWYAWGDKIGENNENLVKMFNESQDKIYVEAEYQGTYDELHSKTQAAFAAKNAPEVTQNEIASIGVFAKSGMTQDLTPFVEKDDINMDDFNPGLMGNSYVDDKLYGLPYLRSTPILYMNTTMLKEAGLDPAGPKDWKEFEEYLTALTKEGKTVGMTMPVNIWMYEAFVAQGEGQMISDDEKSAEFNGEAGVEALEFWKKMADKGVIKVPGGEAAAEVAKQDFANSRSAMAFSSTADLSYNLSVAEEQGFELNTAFMPANKVNGVPTGGANLVMTAGLDEERQNAAWEFIKWMTAKEQTIYASEYTGYLPSRLSAVDSEEMKSLYEKMPQFKVAVDQLQYGHARPMAEAYPEVAKILTDQISRVMLEDGLAPKDALDEAAEKANQLL

SEQ ID NO: 193 - protein, 350 aa, Symbiobacterium thermophilum IAM 14863
VKVTFWHAMGGVAGEAVQRLVDQFNSSQDKVEVEAVYQGTYDDALQKLRAAGSDGPTIMQVYEIGSRFMIDSGMITPMQNFVDADGFSIDDFEPNILGYYTFDGRLYSMPFNTSTPIVYYNKDAFREAGLDPERPPRTFEEFKEYARKLTVTQGGETRYGASIALYGWFFEQFLAVQGAHYVDNDNGRSARATKAIINSPEGERFVTWLKEMVDEGVAINLGRRTADTQAAFSSGQVAMTLDSTAALGNILNGVGDKFEIGTAFLPRPEGAAEGGVIIGGASLWITNTKPLKEQWAAWEFVKWLTTPEVQAEWSIATGYFPVRKAAYDQQILKDWHAQRPQFTTAIEQLR

SEQ ID NO: 194 - protein, 349 aa, Lactobacillus casei
VTITFWHGMNGPYQKALDQIINDFNKSQKQYKVVGTAQGNYTALQQKIMAAAKSRNLPTIAQTTYTTVPDYVKNGFISPLDQYMLKGDDKMSSSDLKDIYPAFLSSSKYQGKYYSVPFSKSTRILFYNEALMKKYNIAKPTSWEDIKKDADKLKADGIAAIGFDKSFDMEFEGLARQAGNPLVSADPLKANLDSKKTLTAANFIMDMVNSGEAKTAGEDIYGDKNFTAGKTLFYAGSSAGITNMKQNAPKDFKWGTMPLPSYKGKKATELAGNDIVLFKSASSDKQKGAWAFMKYLLSEKETSKWSQLTGYVPLRKSAVKSADFKKYLSANPTSQAAVDSLGFGFQSTA

SEQ ID NO: 195 - protein, 446 aa, Artificial
  Substituion in SEQ ID NO 188
MEAKPMKRDRLWKSGALLALGLVATGCGAPAANGGGQAATGASRAAASSQPVTITFWYGVGTTLSQDIQQMVQAFNQTHPGIKVVATYQGSYSGGGEEQQKLLAAIKAGDPPTIAQIEVHAMPVFAASGQLLDLTNLMQSSSVDKPSNFIPGILVSTQYQGRYYAVPFNRSVPVLYYNKTLFAKAHIASPPSNWAQLAADAKKLTSGAGSNKIYGFEPLVDWWPWEYAVESGGGSILSPDLKRATFDQPPALSILETEQSLVKQGYAKVETGPNYWDLMTQDFINGQVAMDIDSIGSAGKVTKGVGDKFQWGTALLPRGKTLAVPPGGGDLAIFKDATPAQQKAAWTFIQWWTAPKQSVQWSTETGYLPVQKADLNDPVYQAYLEKHPQYRTAIEELQYEHPSPASPAYLAVLQPVQQALQGIFDEGKPVAATMHQAAEAADQNLG

SEQ ID NO: 196 - protein, 446 aa, Artificial
  Substituion in SEQ ID NO 188
MEAKPMKRDRLWKSGALLALGLVATGCGAPAANGGGQAATGASRAAASSQPVTITFWYGVGTTLSQDIQQMVQAFNQTHPGIKVVATYQGSYSGGGEEQQKLLAAIKAGDPPTIAQIEVHAMPVFAASGQLLDLTNLMQSSSVDKPSNFLPGILVSTQYQGRYYAVPFNRSVPVLYYNKTLFAKAHIASPPSNWAQLAADAKKLTSGAGSNKIYGFEPLVDWWPWEYAVESGGGSILSPDLKRATFDQPPALSILETEQSLVKQGYAKVETGPNYWDLMTQDFINGQVAMDIDSIGSAGKVTKGVGDKFQWGTALLPRGKTLAVPPGGGDLAIFKDATPAQQKAAWTFIQWWTAPKQSVQWSTETGYLPVQKADLNDPVYQAYLEKHPQYRTAIEELQYEHPSPASPAYIAVLQPVQQALQGIFDEGKPVAATMHQAAEAADQNLG

SEQ ID NO: 197 - protein, 446 aa, Artificial
  Substituion in SEQ ID NO 188
MEAKPMKRDRLWKSGALLALGLVATGCGAPAANGGGQAATGASRAAASSQPVTITFWYGVGTTLSQDIQQMVQAFNQTHPGIKVVATYQGSYSGGGEEQQKLLAAIKAGDPPTIAQIEVHAMPVFAASGQLLDLTNLMQSSSVDKPSNFLPGIIVSTQYQGRYYAVPFNRSVPVLYYNKTLFAKAHIASPPSNWAQLAADAKKLTSGAGSNKIYGFEPLVDWWPWEYAVESGGGSILSPDLKRATFDQPPALSILETEQSLVKQGYAKVETGPNYWDLMTQDFINGQVAMDIDSIGSAGKVTKGVGDKFQWGTALLPRGKTLAVPPGGGDLAIFKDATPAQQKAAWTFIQWWTAPKQSVQWSTETGYLPVQKADLNDPVYQAYLEKHPQYRTAIEELQYEHPSPASPAYLAVLQPVQQALQGIFDEGKPVAATMHQAAEAADQNLG

SEQ ID NO: 198 - protein, 446 aa, Artificial
  Substituion in SEQ ID NO 188
MEAKPMKRDRLWKSGALLALGLVATGCGAPAANGGGQAATGASRAAASSQPVTITFWYGVGTTLSQDIQQMVQAFNQTHPGIKVVATYQGSYSGGGEEQQKLLAAIKAGDPPTIAQIEVHAMPVFAASGQLLDLTNLMQSSSVDKPSNFLPGILVSTQYQGRYYAVPFNRSVPVLYYNKTLFAKAHIASPPSNWAQLAADAKKLTSGAGSNKIYGFEPLVDWWPWEYAVESGGGSILSPDLKRATFDQPPALSILETEQSLVKQGYAKVETGPNYWDLMTQDFINGQVAMDIDSIGSAGKVTKGVGDRFQWGTALLPRGKTLAVPPGGGDLAIFKDATPAQQKAAWTFIQWWTAPKQSVQWSTETGYLPVQKADLNDPVYQAYLEKHPQYRTAIEELQYEHPSPASPAYLAVLQPVQQALQGIFDEGKPVAATMHQAAEAADQNLG

SEQ ID NO: 199 - protein, 446 aa, Artificial
  Substituion in SEQ ID NO 188
MEAKPMKRDRLWKSGALLALGLVATGCGAPAANGGGQAATGASRAAASSQPVTITFWYGVGTTLSQDIQQMVQAFNQTHPGIKVVATYQGSYSGGGEEQQKLLAAIKAGDPPTIAQIEVHAMPVFAASGQLLDLTNLMQSSSVDKPSNFLPGILVSTQYQGRYYAIPFNRSVPVLYYNKTLFAKAHIASPPSNWAQLAADAKKLTSGAGSNKIYGFEPLVDWWPWEYAVESGGGSILSPDLKRATFDQPPALSILETEQSLVKQGYAKVETGPNYWDLMTQDFINGQVAMDIDSIGSAGKVTKGVGDKFQWGTALLPRGKTLAVPPGGGDLAIFKDATPAQQKAAWTFIQWWTAPKQSVQWSTETGYLPVQKADLNDPVYQAYLEKHPQYRTAIEELQYEHPSPASPAYLAVLQPVQQALQGIFDEGKPVAATMHQAAEAADQNLG

SEQ ID NO: 200 - DNA, 1341 bp, Artificial
  Substituion in SEQ ID NO 189
ttggaggcgaaacccatgaagcgagatcgactgtggaaatccggcgcgctcctggcgctcggacttgtggcgacgggatgcggtgcgcccgccgcaaacggcggcggacaggcggcgaccggcgccagccgggccgcggcatcgagccagcccgtgaccatcaccttctggtacggcgtcggcacgacgctcagccaggacattcagcagatggtgcaggcgttcaaccagacccaccccggcatcaaggtcgtggcgacctatcaaggcagctactccggcggcggcgaggaacagcagaagctgctcgcggccatcaaggcgggcgatccgcccaccatcgcacaaattgaggtgcacgcgatgccggttttcgcggcgagcgggcaattgctcgacctcaccaacctgatgcagtcttcgagcgtcgacaagccgtccaacttcattccgggcatcctcgtctcgacccagtaccagggccgatactacgcggtgcccttcaaccgcagcgtgcccgtgctctactacaacaagacgctcttcgcgaaggcgcacatcgcctcgcccccctcgaactgggcgcagctcgcggcggacgcgaagaagctcacgagcggggccggatcgaacaagatctacggtttcgaaccgctcgtcgactggtggccgtgggaatacgcggtggagtcaggcggcggctccatcctgtcgcccgatttgaagcgcgccaccttcgaccagccgcccgcgctctccatcctcgagacggagcagtcgctcgtgaagcagggatacgccaaggtcgagacgggaccgaactactgggacctcatgacgcaggacttcatcaacggccaagtggccatggacatcgactccatcggcagcgcgggcaaggtgacgaagggcgtgggcgacaagttccagtggggcaccgcgctcctgccgcgcggcaagacgctcgccgtcccgccgggcggtggcgatctcgccatcttcaaggacgccacgcccgcgcaacagaaggccgcgtggacgttcatccagtggtggaccgcgcccaagcagtcggtccaatggtccaccgagaccggttacctgcccgtgcagaaggcggatctgaacgaccccgtctaccaggcgtacctcgagaagcacccgcagtaccggaccgccattgaggagctccagtacgagcatccgtcgccggcgtcccccgcgtacctggccgtgctgcagccggtgcaacaggcgctgcaaggcatcttcgacgagggcaagcccgtcgcggccacgatgcatcaggccgcagaggccgccgatcaaaacctcggatga

SEQ ID NO: 201 - DNA, 1341 bp, Artificial
  Substituion in SEQ ID NO 189
ttggaggcgaaacccatgaagcgagatcgactgtggaaatccggcgcgctcctggcgctcggacttgtggcgacgggatgcggtgcgcccgccgcaaacggcggcggacaggcggcgaccggcgccagccgggccgcggcatcgagccagcccgtgaccatcaccttctggtacggcgtcggcacgacgctcagccaggacattcagcagatggtgcaggcgttcaaccagacccaccccggcatcaaggtcgtggcgacctatcaaggcagctactccggcggcggcgaggaacagcagaagctgctcgcggccatcaaggcgggcgatccgcccaccatcgcacaaattgaggtgcacgcgatgccggttttcgcggcgagcgggcaattgctcgacctcaccaacctgatgcagtcttcgagcgtcgacaagccgtccaacttcctgccgggcatcctcgtctcgacccagtaccagggccgatactacgcggtgcccttcaaccgcagcgtgcccgtgctctactacaacaagacgctcttcgcgaaggcgcacatcgcctcgcccccctcgaactgggcgcagctcgcggcggacgcgaagaagctcacgagcggggccggatcgaacaagatctacggtttcgaaccgctcgtcgactggtggccgtgggaatacgcggtggagtcaggcggcggctccatcctgtcgcccgatttgaagcgcgccaccttcgaccagccgcccgcgctctccatcctcgagacggagcagtcgctcgtgaagcagggatacgccaaggtcgagacgggaccgaactactgggacctcatgacgcaggacttcatcaacggccaagtggccatggacatcgactccatcggcagcgcgggcaaggtgacgaagggcgtgggcgacaagttccagtggggcaccgcgctcctgccgcgcggcaagacgctcgccgtcccgccgggcggtggcgatctcgccatcttcaaggacgccacgcccgcgcaacagaaggccgcgtggacgttcatccagtggtggaccgcgcccaagcagtcggtccaatggtccaccgagaccggttacctgcccgtgcagaaggcggatctgaacgaccccgtctaccaggcgtacctcgagaagcacccgcagtaccggaccgccattgaggagctccagtacgagcatccgtcgccggcgtcccccgcgtacattgccgtgctgcagccggtgcaacaggcgctgcaaggcatcttcgacgagggcaagcccgtcgcggccacgatgcatcaggccgcagaggccgccgatcaaaacctcggatga

SEQ ID NO: 202 - DNA, 1341 bp, Artificial
  Substituion in SEQ ID NO 189
ttggaggcgaaacccatgaagcgagatcgactgtggaaatccggcgcgctcctggcgctcggacttgtggcgacgggatgcggtgcgcccgccgcaaacggcggcggacaggcggcgaccggcgccagccgggccgcggcatcgagccagcccgtgaccatcaccttctggtacggcgtcggcacgacgctcagccaggacattcagcagatggtgcaggcgttcaaccagacccaccccggcatcaaggtcgtggcgacctatcaaggcagctactccggcggcggcgaggaacagcagaagctgctcgcggccatcaaggcgggcgatccgcccaccatcgcacaaattgaggtgcacgcgatgccggttttcgcggcgagcgggcaattgctcgacctcaccaacctgatgcagtcttcgagcgtcgacaagccgtccaacttcctgccgggcatcattgtctcgacccagtaccagggccgatactacgcggtgcccttcaaccgcagcgtgcccgtgctctactacaacaagacgctcttcgcgaaggcgcacatcgcctcgcccccctcgaactgggcgcagctcgcggcggacgcgaagaagctcacgagcggggccggatcgaacaagatctacggtttcgaaccgctcgtcgactggtggccgtgggaatacgcggtggagtcaggcggcggctccatcctgtcgcccgatttgaagcgcgccaccttcgaccagccgcccgcgctctccatcctcgagacggagcagtcgctcgtgaagcagggatacgccaaggtcgagacgggaccgaactactgggacctcatgacgcaggacttcatcaacggccaagtggccatggacatcgactccatcggcagcgcgggcaaggtgacgaagggcgtgggcgacaagttccagtggggcaccgcgctcctgccgcgcggcaagacgctcgccgtcccgccgggcggtggcgatctcgccatcttcaaggacgccacgcccgcgcaacagaaggccgcgtggacgttcatccagtggtggaccgcgcccaagcagtcggtccaatggtccaccgagaccggttacctgcccgtgcagaaggcggatctgaacgaccccgtctaccaggcgtacctcgagaagcacccgcagtaccggaccgccattgaggagctccagtacgagcatccgtcgccggcgtcccccgcgtacctggccgtgctgcagccggtgcaacaggcgctgcaaggcatcttcgacgagggcaagcccgtcgcggccacgatgcatcaggccgcagaggccgccgatcaaaacctcggatga

SEQ ID NO: 203 - DNA, 1341 bp, Artificial
  Substituion in SEQ ID NO 189
ttggaggcgaaacccatgaagcgagatcgactgtggaaatccggcgcgctcctggcgctcggacttgtggcgacgggatgcggtgcgcccgccgcaaacggcggcggacaggcggcgaccggcgccagccgggccgcggcatcgagccagcccgtgaccatcaccttctggtacggcgtcggcacgacgctcagccaggacattcagcagatggtgcaggcgttcaaccagacccaccccggcatcaaggtcgtggcgacctatcaaggcagctactccggcggcggcgaggaacagcagaagctgctcgcggccatcaaggcgggcgatccgcccaccatcgcacaaattgaggtgcacgcgatgccggttttcgcggcgagcgggcaattgctcgacctcaccaacctgatgcagtcttcgagcgtcgacaagccgtccaacttcctgccgggcatcctcgtctcgacccagtaccagggccgatactacgcggtgcccttcaaccgcagcgtgcccgtgctctactacaacaagacgctcttcgcgaaggcgcacatcgcctcgcccccctcgaactgggcgcagctcgcggcggacgcgaagaagctcacgagcggggccggatcgaacaagatctacggtttcgaaccgctcgtcgactggtggccgtgggaatacgcggtggagtcaggcggcggctccatcctgtcgcccgatttgaagcgcgccaccttcgaccagccgcccgcgctctccatcctcgagacggagcagtcgctcgtgaagcagggatacgccaaggtcgagacgggaccgaactactgggacctcatgacgcaggacttcatcaacggccaagtggccatggacatcgactccatcggcagcgcgggcaaggtgacgaagggcgtgggcgaccgtttccagtggggcaccgcgctcctgccgcgcggcaagacgctcgccgtcccgccgggcggtggcgatctcgccatcttcaaggacgccacgcccgcgcaacagaaggccgcgtggacgttcatccagtggtggaccgcgcccaagcagtcggtccaatggtccaccgagaccggttacctgcccgtgcagaaggcggatctgaacgaccccgtctaccaggcgtacctcgagaagcacccgcagtaccggaccgccattgaggagctccagtacgagcatccgtcgccggcgtcccccgcgtacctggccgtgctgcagccggtgcaacaggcgctgcaaggcatcttcgacgagggcaagcccgtcgcggccacgatgcatcaggccgcagaggccgccgatcaaaacctcggatga

SEQ ID NO: 204 - DNA, 1341 bp, Artificial
  Substituion in SEQ ID NO 189
ttggaggcgaaacccatgaagcgagatcgactgtggaaatccggcgcgctcctggcgctcggacttgtggcgacgggatgcggtgcgcccgccgcaaacggcggcggacaggcggcgaccggcgccagccgggccgcggcatcgagccagcccgtgaccatcaccttctggtacggcgtcggcacgacgctcagccaggacattcagcagatggtgcaggcgttcaaccagacccaccccggcatcaaggtcgtggcgacctatcaaggcagctactccggcggcggcgaggaacagcagaagctgctcgcggccatcaaggcgggcgatccgcccaccatcgcacaaattgaggtgcacgcgatgccggttttcgcggcgagcgggcaattgctcgacctcaccaacctgatgcagtcttcgagcgtcgacaagccgtccaacttcctgccgggcatcctcgtctcgacccagtaccagggccgatactacgcgattcccttcaaccgcagcgtgcccgtgctctactacaacaagacgctcttcgcgaaggcgcacatcgcctcgcccccctcgaactgggcgcagctcgcggcggacgcgaagaagctcacgagcggggccggatcgaacaagatctacggtttcgaaccgctcgtcgactggtggccgtgggaatacgcggtggagtcaggcggcggctccatcctgtcgcccgatttgaagcgcgccaccttcgaccagccgcccgcgctctccatcctcgagacggagcagtcgctcgtgaagcagggatacgccaaggtcgagacgggaccgaactactgggacctcatgacgcaggacttcatcaacggccaagtggccatggacatcgactccatcggcagcgcgggcaaggtgacgaagggcgtgggcgacaagttccagtggggcaccgcgctcctgccgcgcggcaagacgctcgccgtcccgccgggcggtggcgatctcgccatcttcaaggacgccacgcccgcgcaacagaaggccgcgtggacgttcatccagtggtggaccgcgcccaagcagtcggtccaatggtccaccgagaccggttacctgcccgtgcagaaggcggatctgaacgaccccgtctaccaggcgtacctcgagaagcacccgcagtaccggaccgccattgaggagctccagtacgagcatccgtcgccggcgtcccccgcgtacctggccgtgctgcagccggtgcaacaggcgctgcaaggcatcttcgacgagggcaagcccgtcgcggccacgatgcatcaggccgcagaggccgccgatcaaaacctcggatga

SEQ ID NO: 205 - protein, 311 aa, Alicyclobacillus acidocaldarius
MAKAAEAVIAQVEGERRSARGSMSLQITGLAMMAPALLFLLAFVFVPMGYAVYLSLYQSTLYTPQPVFAGFANYAHLLAAPDFWQAASNTLWLAVGMMALSLPVALVLALLLNQRIRGRALFRAAVFGPYVIPLVSSGLIFSLLFATDGGPVNLALQRLGLSPVNWLGQGRTALLSVLILTAWQFTGYYAIIFLAGLQSVPTSLMEACQVDGGGRWQVFRHVTLRALGPSLFFAVVICLIQTFQTFDQVYVMTGGGPDGATTTFAYYIFEKGFQAFNIGESSAASVILILVLACLSYLQMRLSRRWVVEES

SEQ ID NO: 206 - DNA, 936 bp, Alicyclobacillus acidocaldarius
gtggccaaggccgccgaagccgtgatcgcacaggtggaaggggagaggcgctccgcgcgaggcagcatgtcgcttcaaatcaccggcctcgcgatgatggcgcccgcgcttctcttcctgctcgcgttcgtgtttgtgccgatgggctacgcggtgtacctgagcctgtaccagtcgacgctgtacaccccgcaaccggtgttcgccggattcgccaactacgcgcacctgcttgccgcgcccgatttttggcaggcggcgtcgaacacgctgtggctggccgtcggcatgatggcgctgtcgctgcccgtggcccttgtgctcgccctgcttctgaaccagcgcatccgcgggcgggcgttgttccgcgccgccgtcttcggcccgtacgtaattccgctcgtgagctcaggcctcatcttctcgcttctcttcgccacggacgggggaccggtgaatctggcgcttcagcgcctcggcctgtcgccggtcaactggctcggccaagggcggacggcgcttctgtccgtgctcatcctcaccgcgtggcagttcaccggctattacgccatcatcttcctcgccggtctgcagagcgtgccgacgtccctgatggaggcgtgccaggtggacggcggcgggcggtggcaggtatttcgccacgtgacgctgcgcgcgctcgggccaagcctgttcttcgccgtcgtcatctgcctcatccagacgttccagacctttgatcaggtgtacgtcatgaccggaggcggtccagacggcgcgaccaccacgttcgcctattacatcttcgagaaaggctttcaagcgttcaacatcggggagtcttcagcggcgagcgtcatcctgatcctcgtgctcgcgtgcctctcgtacctgcagatgcgcttgagccgccgatgggtggtggaggaatcgtga

SEQ ID NO: 207 - protein, 255 aa, Deinococcus geothermalis DSM 11300
YSLYLSFFEWNGFTPNRDWVGGGNYARLLTSPEFWNSLKVTALYAGGVTLTSLALGLLVAVLLNQPIRGRTFYRVLYFLPVITPTVAAGVVWKYLFDPTQGAVNSLLGSVGLHGPNWLVDPKWALLAVIIVGVWKRVGFNVVVYLAALQGVPRAYYEAAQIDGATPWQQLRFVTVPLLAPTTFFLVITSLIEAFQVFDLVYVMTAGGPLGATDVFGFYLYREGFKYSQLGFASAIAYVMFALIFLATVVQFRFTR

SEQ ID NO: 208 - protein, 251 aa, Anabaena variabilis ATCC 29413
YLFYLSFTAGSFTSTGTYWVGFKNYWRLLLNPDFWQVIGNTVYFTVASVIPSLVIPLGLAVLLNRSMALRGVLRSAYFLPSIISLVAAGLGFRWLFQTSGPVNAFLNIFGIPAISWLGDTFWAMPVLIILSIWKQLGFNMVVFLAGLQAIPPSRYEAAELDGANGWRQFWHITLPGLRPTLIFATVTTAIFTLRSFEQVYVMTGGGPLNTTNLLVYYIYQEAFGQFDFGYAAAAATVLLAMALVLVYLQLR

SEQ ID NO: 209 - protein, 251 aa, Nostoc sp. PCC 7120; identical to SEQ ID NO: 208

SEQ ID NO: 210 - protein, 251 aa, Nodularia spumigena CCY9414
YLFYLSFTAGSFTSSGTTWVGLRNYWRLLLTPDFWQVLGNTIYFTVATVIPSLVIPLALAVLLDKSLALRGLLRSAYFLPSIISLVAAGLGFRWLFQTDGPANAFLDFFGIAPIPWLGSTTWAMPVLIVLSIWKQLGFNMVVFLAGLQAIPPSRYEAAELDGANAWQQFWHVTLPGLQPTMIFATVTTAIFTLRSFEQVYVITGGGPLNSTNLLVYYIYQEAFAQFDFGYAAAAATVLLAFTLVFVYLQLQ

SEQ ID NO: 211 - protein, 253 aa, Thermus brockianus
YSLYLSFLNTRVYPWRLEVGVNWGRLLQDPFFWTALKNTLFILLVQVPLMLALALLALALNSALLRAKGFFRFAFFAPVVVGAVAYSAVFRLLFNTEFGAVNALLRTLGHPGYDWLYAPGPAMAVIIIALTWRWTGYNAIILLAGLQSIPKELYEAAALDGAGPWQRFWHVTLPGIRPVLLFALILSIIGTLQLFTEPFLITGGGPGNATMTLGVYLYQQGFRSFNFGYASAIAYTVALLAALFSFLQMRLWR

SEQ ID NO: 212 - protein, 311 aa, Artificial
  Substituion in SEQ ID NO 205
MAKAAEAVIAQVEGERRSARGSMSLQITGLAMMAPALLFLLAFVFVPMGYAVYLSLYQSTLYTPQPVFAGFANYAHLLAAPDFWQAASNTLWLAVGMMALSLPVALVLALLLNQRIRGRALFRAAVFGPYVIPLVSSGLIFSLLFATDGGPVNLALQRLGLSPVNWLGQGRTALLSVLILTAWQFTGYYAIIFLAGLQSVPTSLMEACQVDGGGRWQVFRHITLRALGPSLFFAVVICLIQTFQTFDQVYVMTGGGPDGATTTFAYYIFEKGFQAFNIGESSAASVILILVLACLSYLQMRLSRRWVVEES

SEQ ID NO: 213 - protein, 311 aa, Artificial
  Substituion in SEQ ID NO 205
MAKAAEAVIAQVEGERRSARGSMSLQITGLAMMAPALLFLLAFVFVPMGYAVYLSLYQSTLYTPQPVFAGFANYAHLLAAPDFWQAASNTLWLAVGMMALSLPVALVLALLLNQRIRGRALFRAAVFGPYVIPLVSSGLIFSLLFATDGGPVNLALQRIGLSPVNWLGQGRTALLSVLILTAWQFTGYYAIIFLAGLQSVPTSLMEACQVDGGGRWQVFRHVTLRALGPSLFFAVVICLIQTFQTFDQVYVMTGGGPDGATTTFAYYIFEKGFQAFNIGESSAASVILILVLACLSYLQMRLSRRWVVEES

SEQ ID NO: 214 - protein, 311 aa, Artificial
  Substituion in SEQ ID NO 205
MAKAAEAVIAQVEGERRSARGSMSLQITGLAMMAPALLFLLAFVFVPMGYAVYLSLYQSTLYTPQPVFAGFANYAHLLAAPDFWQAASNTLWLAVGMMALSLPVALVLALLLNQRIRGRALFRAAVFGPYVIPLVSSGLIFSLLFATDGGPVNLALQRLGLSPVNWLGQGRTALLSVLILTAWQFTGYYAIIFLAGLQSIPTSLMEACQVDGGGRWQVFRHVTLRALGPSLFFAVVICLIQTFQTFDQVYVMTGGGPDGATTTFAYYIFEKGFQAFNIGESSAASVILILVLACLSYLQMRLSRRWVVEES

SEQ ID NO: 215 - protein, 311 aa, Artificial
  Substituion in SEQ ID NO 205
MAKAAEAVIAQVEGERRSARGSMSLQITGLAMMAPALLFLLAFVFVPMGYAVYLSLYNSTLYTPQPVFAGFANYAHLLAAPDFWQAASNTLWLAVGMMALSLPVALVLALLLNQRIRGRALFRAAVFGPYVIPLVSSGLIFSLLFATDGGPVNLALQRLGLSPVNWLGQGRTALLSVLILTAWQFTGYYAIIFLAGLQSVPTSLMEACQVDGGGRWQVFRHVTLRALGPSLFFAVVICLIQTFQTFDQVYVMTGGGPDGATTTFAYYIFEKGFQAFNIGESSAASVILILVLACLSYLQMRLSRRWVVEES

SEQ ID NO: 216 - protein, 311 aa, Artificial
  Substituion in SEQ ID NO 205
MAKAAEAVIAQVEGERRSARGSMSLQITGLAMMAPALLFLIAFVFVPMGYAVYLSLYQSTLYTPQPVFAGFANYAHLLAAPDFWQAASNTLWLAVGMMALSLPVALVLALLLNQRIRGRALFRAAVFGPYVIPLVSSGLIFSLLFATDGGPVNLALQRLGLSPVNWLGQGRTALLSVLILTAWQFTGYYAIIFLAGLQSVPTSLMEACQVDGGGRWQVFRHVTLRALGPSLFFAVVICLIQTFQTFDQVYVMTGGGPDGATTTFAYYIFEKGFQAFNIGESSAASVILILVLACLSYLQMRLSRRWVVEES

SEQ ID NO: 217 - DNA, 936 bp, Artificial
  Substituion in SEQ ID NO 206
gtggccaaggccgccgaagccgtgatcgcacaggtggaaggggagaggcgctccgcgcgaggcagcatgtcgcttcaaatcaccggcctcgcgatgatggcgcccgcgcttctcttcctgctcgcgttcgtgtttgtgccgatgggctacgcggtgtacctgagcctgtaccagtcgacgctgtacaccccgcaaccggtgttcgccggattcgccaactacgcgcacctgcttgccgcgcccgatttttggcaggcggcgtcgaacacgctgtggctggccgtcggcatgatggcgctgtcgctgcccgtggcccttgtgctcgccctgcttctgaaccagcgcatccgcgggcgggcgttgttccgcgccgccgtcttcggcccgtacgtaattccgctcgtgagctcaggcctcatcttctcgcttctcttcgccacggacgggggaccggtgaatctggcgcttcagcgcctcggcctgtcgccggtcaactggctcggccaagggcggacggcgcttctgtccgtgctcatcctcaccgcgtggcagttcaccggctattacgccatcatcttcctcgccggtctgcagagcgtgccgacgtccctgatggaggcgtgccaggtggacggcggcgggcggtggcaggtatttcgccacattacgctgcgcgcgctcgggccaagcctgttcttcgccgtcgtcatctgcctcatccagacgttccagacctttgatcaggtgtacgtcatgaccggaggcggtccagacggcgcgaccaccacgttcgcctattacatcttcgagaaaggctttcaagcgttcaacatcggggagtcttcagcggcgagcgtcatcctgatcctcgtgctcgcgtgcctctcgtacctgcagatgcgcttgagccgccgatgggtggtggaggaatcgtga

SEQ ID NO: 218 - DNA, 936 bp, Artificial
  Substituion in SEQ ID NO 206
gtggccaaggccgccgaagccgtgatcgcacaggtggaaggggagaggcgctccgcgcgaggcagcatgtcgcttcaaatcaccggcctcgcgatgatggcgcccgcgcttctcttcctgctcgcgttcgtgtttgtgccgatgggctacgcggtgtacctgagcctgtaccagtcgacgctgtacaccccgcaaccggtgttcgccggattcgccaactacgcgcacctgcttgccgcgcccgatttttggcaggcggcgtcgaacacgctgtggctggccgtcggcatgatggcgctgtcgctgcccgtggcccttgtgctcgccctgcttctgaaccagcgcatccgcgggcgggcgttgttccgcgccgccgtcttcggcccgtacgtaattccgctcgtgagctcaggcctcatcttctcgcttctcttcgccacggacgggggaccggtgaatctggcgcttcagcgcattggcctgtcgccggtcaactggctcggccaagggcggacggcgcttctgtccgtgctcatcctcaccgcgtggcagttcaccggctattacgccatcatcttcctcgccggtctgcagagcgtgccgacgtccctgatggaggcgtgccaggtggacggcggcgggcggtggcaggtatttcgccacgtgacgctgcgcgcgctcgggccaagcctgttcttcgccgtcgtcatctgcctcatccagacgttccagacctttgatcaggtgtacgtcatgaccggaggcggtccagacggcgcgaccaccacgttcgcctattacatcttcgagaaaggctttcaagcgttcaacatcggggagtcttcagcggcgagcgtcatcctgatcctcgtgctcgcgtgcctctcgtacctgcagatgcgcttgagccgccgatgggtggtggaggaatcgtga

SEQ ID NO: 219 - DNA, 936 bp, Artificial
  Substituion in SEQ ID NO 206
gtggccaaggccgccgaagccgtgatcgcacaggtggaaggggagaggcgctccgcgcgaggcagcatgtcgcttcaaatcaccggcctcgcgatgatggcgcccgcgcttctcttcctgctcgcgttcgtgtttgtgccgatgggctacgcggtgtacctgagcctgtaccagtcgacgctgtacaccccgcaaccggtgttcgccggattcgccaactacgcgcacctgcttgccgcgcccgatttttggcaggcggcgtcgaacacgctgtggctggccgtcggcatgatggcgctgtcgctgcccgtggcccttgtgctcgccctgcttctgaaccagcgcatccgcgggcgggcgttgttccgcgccgccgtcttcggcccgtacgtaattccgctcgtgagctcaggcctcatcttctcgcttctcttcgccacggacgggggaccggtgaatctggcgcttcagcgcctcggcctgtcgccggtcaactggctcggccaagggcggacggcgcttctgtccgtgctcatcctcaccgcgtggcagttcaccggctattacgccatcatcttcctcgccggtctgcagagcattccgacgtccctgatggaggcgtgccaggtggacggcggcgggcggtggcaggtatttcgccacgtgacgctgcgcgcgctcgggccaagcctgttcttcgccgtcgtcatctgcctcatccagacgttccagacctttgatcaggtgtacgtcatgaccggaggcggtccagacggcgcgaccaccacgttcgcctattacatcttcgagaaaggctttcaagcgttcaacatcggggagtcttcagcggcgagcgtcatcctgatcctcgtgctcgcgtgcctctcgtacctgcagatgcgcttgagccgccgatgggtggtggaggaatcgtga

SEQ ID NO: 220 - DNA, 936 bp, Artificial
  Substituion in SEQ ID NO 206
gtggccaaggccgccgaagccgtgatcgcacaggtggaaggggagaggcgctccgcgcgaggcagcatgtcgcttcaaatcaccggcctcgcgatgatggcgcccgcgcttctcttcctgctcgcgttcgtgtttgtgccgatgggctacgcggtgtacctgagcctgtacaattcgacgctgtacaccccgcaaccggtgttcgccggattcgccaactacgcgcacctgcttgccgcgcccgatttttggcaggcggcgtcgaacacgctgtggctggccgtcggcatgatggcgctgtcgctgcccgtggcccttgtgctcgccctgcttctgaaccagcgcatccgcgggcgggcgttgttccgcgccgccgtcttcggcccgtacgtaattccgctcgtgagctcaggcctcatcttctcgcttctcttcgccacggacgggggaccggtgaatctggcgcttcagcgcctcggcctgtcgccggtcaactggctcggccaagggcggacggcgcttctgtccgtgctcatcctcaccgcgtggcagttcaccggctattacgccatcatcttcctcgccggtctgcagagcgtgccgacgtccctgatggaggcgtgccaggtggacggcggcgggcggtggcaggtatttcgccacgtgacgctgcgcgcgctcgggccaagcctgttcttcgccgtcgtcatctgcctcatccagacgttccagacctttgatcaggtgtacgtcatgaccggaggcggtccagacggcgcgaccaccacgttcgcctattacatcttcgagaaaggctttcaagcgttcaacatcggggagtcttcagcggcgagcgtcatcctgatcctcgtgctcgcgtgcctctcgtacctgcagatgcgcttgagccgccgatgggtggtggaggaatcgtga

SEQ ID NO: 221 - DNA, 936 bp, Artificial
  Substituion in SEQ ID NO 206
gtggccaaggccgccgaagccgtgatcgcacaggtggaaggggagaggcgctccgcgcgaggcagcatgtcgcttcaaatcaccggcctcgcgatgatggcgcccgcgcttctcttcctgattgcgttcgtgtttgtgccgatgggctacgcggtgtacctgagcctgtaccagtcgacgctgtacaccccgcaaccggtgttcgccggattcgccaactacgcgcacctgcttgccgcgcccgatttttggcaggcggcgtcgaacacgctgtggctggccgtcggcatgatggcgctgtcgctgcccgtggcccttgtgctcgccctgcttctgaaccagcgcatccgcgggcgggcgttgttccgcgccgccgtcttcggcccgtacgtaattccgctcgtgagctcaggcctcatcttctcgcttctcttcgccacggacgggggaccggtgaatctggcgcttcagcgcctcggcctgtcgccggtcaactggctcggccaagggcggacggcgcttctgtccgtgctcatcctcaccgcgtggcagttcaccggctattacgccatcatcttcctcgccggtctgcagagcgtgccgacgtccctgatggaggcgtgccaggtggacggcggcgggcggtggcaggtatttcgccacgtgacgctgcgcgcgctcgggccaagcctgttcttcgccgtcgtcatctgcctcatccagacgttccagacctttgatcaggtgtacgtcatgaccggaggcggtccagacggcgcgaccaccacgttcgcctattacatcttcgagaaaggctttcaagcgttcaacatcggggagtcttcagcggcgagcgtcatcctgatcctcgtgctcgcgtgcctctcgtacctgcagatgcgcttgagccgccgatgggtggtggaggaatcgtga

SEQ ID NO: 222 - protein, 309 aa, Alicyclobacillus acidocaldarius
MLKWPSTDLKGNPSIRMSTRSTSFKPRIVFETPSPGLLTIWWRTRKVSRVLGVQRMREIIEYRPMLTSLVRSELRARYKGSVLGFLWTFVNPLLQLAVYSLVFKVILRSNIRDYPVFLFIGLLAWNMFTGALQSSCGVIVNKASLVKKIYFPREILPASMAGTALVNYVLSLAILIPILLITGFWPTWSWLFAPVAIVAIFFMALGLSLIFSAINVYMRDTEHILNIVLMLWFYGTPVVYSINSVPHFLSALFKVDPIAAAILVLQEIFYYREIPHWKMLIYCVVSGVCILWIGWAIFYKLSRRFAEEV

SEQ ID NO: 223 - DNA, 930 bp, Alicyclobacillus acidocaldarius
atgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattgaataccgacccatgcttacaagtcttgtacggtcggagcttcgtgcgcggtataaggggtcagtcttaggttttctatggactttcgtgaatccgctcttgcaactcgcggtgtacagcctcgtcttcaaagtgatcttgcgctctaatattagagactatcctgtatttctttttatcgggctgctggcatggaacatgttcacaggagcactgcagagttcttgcggtgtgattgtcaataaggcatccttagtcaagaaaatctactttcctagagaaattctacctgcttctatggccggcacagcacttgtcaattatgttctgtcgcttgctattctcattcctatcttgctgattaccggtttctggccgacttggagttggttattcgcacctgttgcaatcgtggctatttttttcatggcattgggactctctctaatattctctgctatcaatgtatacatgagggataccgaacacatcttgaacatcgtgctgatgctttggttttacggaacacctgtcgtatattcgatcaactctgttccccacttcctttcagctttgtttaaagtagatccgatagcggcagcgatccttgtcttacaggagatcttttattaccgcgaaatccctcattggaaaatgttgatatattgtgttgttagcggtgtctgcattctttggatcggatgggctattttctataagctcagtcgccggtttgcggaggaggtgtga

SEQ ID NO: 224 - protein, 258 aa, Clostridium bolteae ATCC BAA-613
MQLFKEIYAYREMIFSLVRRDLKGRYKGSALGFFWTFLNPLLQLVVYTFVFSVIMKSDVEYYYLHLFVALVPWLFFSMSVSEGCSCIRSQQDMVKKIYFPREVLPIAYVTSQFINMLLSFVVVLLVVLLSGRGLNLVALLYLPIIAIVEYLLCLGSALLVSAITVYVRDMEYLLKIVTMALQFLTPVMYSIDIVPERYMAIYVLNPMTPIIVAYRDILYYGKIPRLTTLLHAVLMGVVLLVIGFLVFGKLKRRFAEEL

SEQ ID NO: 225 - protein, 254 aa, Clostridium sp. L2-50
KEIYDYRTMIVSLTKRDLIGRYKRSVLGFLWSFIDPLIQLAVYTFLFKIILPTNIPFFHICLFVALVPWLMISSCLTGGCMCVAGQQDMIKKIYFPREVLPIAFVSAQFINMLLSFIIVFVVLGASGYGFCGKALLLFPVVVIIEYILALGMTLFFSAVTVYFRDMQQILGALSLILMYASPIIYTLELVPEKYRPFYMINPITRVIVAYRDIFYYKQVPEFSNIILGLLESIIVLIIGLVVFRKLNKHFAEEL

SEQ ID NO: 226 - protein, 258 aa, Stigmatella aurantiaca DW4/3-1
LRNLRELYQYRGLLLSLTQRELKARYRGSVLGFLWTFLNPMLQMVVYTLLFSVYMRQQIEHYPYFMFVGLLPWIWFSSSIGAGASAISDRRDLLTKVRFPAQVLPATVVVTNLCNFLLSVPLLIVFGLVLGRWPSWHLLFFPVIVLIQFCVTMGLAYLISAINVTFRDLQQIVANLLTMWFFVTPIFYRTSTVPDQFRELVVLANPMAVMVTSYQAIFYDHQMPAPGPLLLWMGIAIVLMVVASSIFERRREEFAEVI

SEQ ID NO: 227 - protein, 259 aa, Myxococcus xanthus DK 1622
IRLVRELYQYRGLLISLVQRELKARYRGSFLGFLWTFLNPTLHMLVYVLLFTVVMRQNIPNFPFFMFVGLLPWIWFSTSVGGGASAISDRRDLLTKVRFPAQVLPTSVVVTNLCNFVLSLPLMLVLGMAYGQWPTWHVVLFPVVVLIQLTFTLALTYILAAINVTFRDLQHIVSNLLTLWFFATPVLYPLSTIQDESARSLMLALNPMVSLMTSYQAIFYEHRLPDAEPLMALAAVSVVLLWAASSIFESRREEFAESI

SEQ ID NO: 228 - protein, 257 aa, Clostridium acetobutylicum ATCC 824
INSIKEILKYKELLQNLTMKELKLKYRNSALGFFWSFLNPIMLLIVYTFAFKYIMHQTTPNYTVTLLAALLPWQFFQGAVQGSTTSIISNSNLIKKIYFPRQIMPLSIIFSNFVSFLITLVILFGAMIVSQVPFSFTILLLPIILLLLLVFSVGLSLILSSLNVLYRDVSHFVEVLFMLWFYLTPIVYVLDRIPILYKNILLINPMTMIVECIRSVLLEGKMPNPFYIVVILVWDIVLLYVGDRIFRKIENDFAEEV

SEQ ID NO: 229 - protein, 309 aa, Artificial
  Substituion in SEQ ID NO 222
MLKWPSTDLKGNPSIRMSTRSTSFKPRIVFETPSPGLLTIWWRTRKISRVLGVQRMREIIEYRPMLTSLVRSELRARYKGSVLGFLWTFVNPLLQLAVYSLVFKVILRSNIRDYPVFLFIGLLAWNMFTGALQSSCGVIVNKASLVKKIYFPREILPASMAGTALVNYVLSLAILIPILLITGFWPTWSWLFAPVAIVAIFFMALGLSLIFSAINVYMRDTEHILNIVLMLWFYGTPVVYSINSVPHFLSALFKVDPIAAAILVLQEIFYYREIPHWKMLIYCVVSGVCILWIGWAIFYKLSRRFAEEV

SEQ ID NO: 230 - protein, 309 aa, Artificial
  Substituion in SEQ ID NO 222
MLKWPSTDLKGNPSIRMSTRSTSFKPRIVFETPSPGLLTIWWRTRKVSRVLGVQRMREIIEYRPMLTSLVRSELRARYKGSVLGFLWTFVNPLLQLAVYSLVFKVILRSNIRDYPVFLFIGLLAWNMFTGALQSSCGVIVNKASLVKKIYFPREILPASMAGTALVNYVLSLAILIPILLITGFWPTWSWLFAPIAIVAIFFMALGLSLIFSAINVYMRDTEHILNIVLMLWFYGTPVVYSINSVPHFLSALFKVDPIAAAILVLQEIFYYREIPHWKMLIYCVVSGVCILWIGWAIFYKLSRRFAEEV

SEQ ID NO: 231 - protein, 309 aa, Artificial
  Substituion in SEQ ID NO 222
MLKWPSTDLKGNPSIRMSTRSTSFKPRIVFETPSPGLLTIWWRTRKVSRVLGVNRMREIIEYRPMLTSLVRSELRARYKGSVLGFLWTFVNPLLQLAVYSLVFKVILRSNIRDYPVFLFIGLLAWNMFTGALQSSCGVIVNKASLVKKIYFPREILPASMAGTALVNYVLSLAILIPILLITGFWPTWSWLFAPVAIVAIFFMALGLSLIFSAINVYMRDTEHILNIVLMLWFYGTPVVYSINSVPHFLSALFKVDPIAAAILVLQEIFYYREIPHWKMLIYCVVSGVCILWIGWAIFYKLSRRFAEEV

SEQ ID NO: 232 - protein, 309 aa, Artificial
  Substituion in SEQ ID NO 222
MLKWPSTDLKGNPSIRMSTRSTSFKPRIVFETPSPGLLTIWWRTRKVSRVLGVQRMREIIEYRPMLTSLVRSELRARYKGSVLGFLWTFVNPLLQLAVYSLVFKVILRSQIRDYPVFLFIGLLAWNMFTGALQSSCGVIVNKASLVKKIYFPREILPASMAGTALVNYVLSLAILIPILLITGFWPTWSWLFAPVAIVAIFFMALGLSLIFSAINVYMRDTEHILNIVLMLWFYGTPVVYSINSVPHFLSALFKVDPIAAAILVLQEIFYYREIPHWKMLIYCVVSGVCILWIGWAIFYKLSRRFAEEV

SEQ ID NO: 233 - protein, 309 aa, Artificial
  Substituion in SEQ ID NO 222
MLKWPSTDLKGNPSIRMSTRSTSFKPRIVFETPSPGLLTIWWRTRKVSRVLGVQRMREIIEYRPMLTSLVRSELRARYKGSVLGFLWTFVNPLLQLAVYSLVFKVILRSNIRDYPVFLFIGLLAWNMFTGALQSSCGVIVNKASLVKKIYFPREILPASMAGTALVNYVLSLAILIPILLITGFWPTWSWLFAPVAIVAIFFMALGLSLIFSAINVYMRDTEHILNIVLMLWFYGTPVVYSINSVPHFLSALFKVDPIAAAILVLQEIFYYREIPHWKMLIYCVVSGVCILWIGWAIFYKLSRRFAEDV

SEQ ID NO: 234 - DNA, 930 bp, Artificial
  Substituion in SEQ ID NO 223
atgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaagattagtcgcgtgttgggcgtgcagcggatgcgcgagatcattgaataccgacccatgcttacaagtcttgtacggtcggagcttcgtgcgcggtataaggggtcagtcttaggttttctatggactttcgtgaatccgctcttgcaactcgcggtgtacagcctcgtcttcaaagtgatcttgcgctctaatattagagactatcctgtatttctttttatcgggctgctggcatggaacatgttcacaggagcactgcagagttcttgcggtgtgattgtcaataaggcatccttagtcaagaaaatctactttcctagagaaattctacctgcttctatggccggcacagcacttgtcaattatgttctgtcgcttgctattctcattcctatcttgctgattaccggtttctggccgacttggagttggttattcgcacctgttgcaatcgtggctatttttttcatggcattgggactctctctaatattctctgctatcaatgtatacatgagggataccgaacacatcttgaacatcgtgctgatgctttggttttacggaacacctgtcgtatattcgatcaactctgttccccacttcctttcagctttgtttaaagtagatccgatagcggcagcgatccttgtcttacaggagatcttttattaccgcgaaatccctcattggaaaatgttgatatattgtgttgttagcggtgtctgcattctttggatcggatgggctattttctataagctcagtcgccggtttgcggaggaggtgtga

SEQ ID NO: 235 - DNA, 930 bp, Artificial
  Substituion in SEQ ID NO 223
atgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattgaataccgacccatgcttacaagtcttgtacggtcggagcttcgtgcgcggtataaggggtcagtcttaggttttctatggactttcgtgaatccgctcttgcaactcgcggtgtacagcctcgtcttcaaagtgatcttgcgctctaatattagagactatcctgtatttctttttatcgggctgctggcatggaacatgttcacaggagcactgcagagttcttgcggtgtgattgtcaataaggcatccttagtcaagaaaatctactttcctagagaaattctacctgcttctatggccggcacagcacttgtcaattatgttctgtcgcttgctattctcattcctatcttgctgattaccggtttctggccgacttggagttggttattcgcacctattgcaatcgtggctatttttttcatggcattgggactctctctaatattctctgctatcaatgtatacatgagggataccgaacacatcttgaacatcgtgctgatgctttggttttacggaacacctgtcgtatattcgatcaactctgttccccacttcctttcagctttgtttaaagtagatccgatagcggcagcgatccttgtcttacaggagatcttttattaccgcgaaatccctcattggaaaatgttgatatattgtgttgttagcggtgtctgcattctttggatcggatgggctattttctataagctcagtcgccggtttgcggaggaggtgtga

SEQ ID NO: 236 - DNA, 930 bp, Artificial
  Substituion in SEQ ID NO 223
atgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgaatcggatgcgcgagatcattgaataccgacccatgcttacaagtcttgtacggtcggagcttcgtgcgcggtataaggggtcagtcttaggttttctatggactttcgtgaatccgctcttgcaactcgcggtgtacagcctcgtcttcaaagtgatcttgcgctctaatattagagactatcctgtatttctttttatcgggctgctggcatggaacatgttcacaggagcactgcagagttcttgcggtgtgattgtcaataaggcatccttagtcaagaaaatctactttcctagagaaattctacctgcttctatggccggcacagcacttgtcaattatgttctgtcgcttgctattctcattcctatcttgctgattaccggtttctggccgacttggagttggttattcgcacctgttgcaatcgtggctatttttttcatggcattgggactctctctaatattctctgctatcaatgtatacatgagggataccgaacacatcttgaacatcgtgctgatgctttggttttacggaacacctgtcgtatattcgatcaactctgttccccacttcctttcagctttgtttaaagtagatccgatagcggcagcgatccttgtcttacaggagatcttttattaccgcgaaatccctcattggaaaatgttgatatattgtgttgttagcggtgtctgcattctttggatcggatgggctattttctataagctcagtcgccggtttgcggaggaggtgtga

SEQ ID NO: 237 - DNA, 930 bp, Artificial
  Substituion in SEQ ID NO 223
atgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattgaataccgacccatgcttacaagtcttgtacggtcggagcttcgtgcgcggtataaggggtcagtcttaggttttctatggactttcgtgaatccgctcttgcaactcgcggtgtacagcctcgtcttcaaagtgatcttgcgctctcaaattagagactatcctgtatttctttttatcgggctgctggcatggaacatgttcacaggagcactgcagagttcttgcggtgtgattgtcaataaggcatccttagtcaagaaaatctactttcctagagaaattctacctgcttctatggccggcacagcacttgtcaattatgttctgtcgcttgctattctcattcctatcttgctgattaccggtttctggccgacttggagttggttattcgcacctgttgcaatcgtggctatttttttcatggcattgggactctctctaatattctctgctatcaatgtatacatgagggataccgaacacatcttgaacatcgtgctgatgctttggttttacggaacacctgtcgtatattcgatcaactctgttccccacttcctttcagctttgtttaaagtagatccgatagcggcagcgatccttgtcttacaggagatcttttattaccgcgaaatccctcattggaaaatgttgatatattgtgttgttagcggtgtctgcattctttggatcggatgggctattttctataagctcagtcgccggtttgcggaggaggtgtga

SEQ ID NO: 238 - DNA, 930 bp, Artificial
  Substituion in SEQ ID NO 223
atgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattgaataccgacccatgcttacaagtcttgtacggtcggagcttcgtgcgcggtataaggggtcagtcttaggttttctatggactttcgtgaatccgctcttgcaactcgcggtgtacagcctcgtcttcaaagtgatcttgcgctctaatattagagactatcctgtatttctttttatcgggctgctggcatggaacatgttcacaggagcactgcagagttcttgcggtgtgattgtcaataaggcatccttagtcaagaaaatctactttcctagagaaattctacctgcttctatggccggcacagcacttgtcaattatgttctgtcgcttgctattctcattcctatcttgctgattaccggtttctggccgacttggagttggttattcgcacctgttgcaatcgtggctatttttttcatggcattgggactctctctaatattctctgctatcaatgtatacatgagggataccgaacacatcttgaacatcgtgctgatgctttggttttacggaacacctgtcgtatattcgatcaactctgttccccacttcctttcagctttgtttaaagtagatccgatagcggcagcgatccttgtcttacaggagatcttttattaccgcgaaatccctcattggaaaatgttgatatattgtgttgttagcggtgtctgcattctttggatcggatgggctattttctataagctcagtcgccggtttgcggaggatgtgtga

SEQ ID NO: 239 - protein, 392 aa, Alicyclobacillus acidocaldarius
MATSAIEVCNVTKSFRVHIGKNQTLKEKLFYMGKSKYRDFIALKDVSVRIPKGATVGLIGMNGSGKSTLLKLISRIIYPDKGEIRVHGRVSSLLELGAGFHPEFTGLENIYMNAAILGLSKREVDKKLAEIVEFSELGDFLNEPVRSYSSGMYMRLAFSVAVAVDPEILLVDEVLAVGDAAFQEKCLERVRRLRREGKTIVIVTHDTGVVEQLCDHVVWLHNSRVRMEGRPEECIPHYLDEILGERRGTGMSFDRVEQPPLQPGDELKDLGLGLRVGIRENAEVLPNDGGIRVVYEASAAHEVCCEASVVIRRLGDPQELRPRCNEKIALPKGHSVLELHATLDRALYPGEYMIELVLQVNDHILRAPATRLWIPHSSQEESLQLQVSVQTA

SEQ ID NO: 240 - DNA, 1179 bp, Alicyclobacillus acidocaldarius
atggccacaagtgctattgaggtatgcaatgtcaccaagtcgtttcgtgtccatattgggaaaaatcagacgttaaaagaaaaattgttctacatggggaagagcaagtatcgagattttatcgcgctcaaagacgtgtccgtgcgaattcccaaaggagccaccgttggactcattggcatgaacggttcaggtaagagtacgctcttaaaactgatatctcgcattatatatccagataaaggggaaattcgtgttcacggacgggtttctagcttactggagcttggtgcaggctttcatccggagtttacggggttagagaacatctatatgaatgcagccatactgggattgtcaaagcgcgaggtggacaagaagctggccgagatcgtcgagttctctgagttaggtgattttctgaatgagcccgttcgaagctactcgtcgggtatgtacatgaggctcgccttctctgtcgcggtcgcggtggatccggaaattttgctcgtggacgaagtattagcggtgggagacgctgcttttcaggagaaatgccttgaacgtgtccgcaggttgagaagagagggaaagacgatcgtcattgtcacacacgacacgggagtcgtggaacaattgtgcgatcacgtggtctggttacataactcgcgcgttcgaatggaagggcggccggaggaatgtatcccacattatctagacgaaatcctaggagagcgtaggggaacgggcatgtcgtttgaccgagtggaacaaccacctttgcaacccggcgatgaactgaaggacttgggtttgggattacgtgtcggcattcgagaaaatgccgaagttcttccgaacgacggcgggattcgggtcgtctacgaggcgtcggccgcgcatgaggtctgctgtgaggcgagcgtcgtgattcggcgtcttggcgacccacaagaacttcggcctaggtgcaacgaaaagatcgcattgcctaaggggcattcagttcttgagttgcatgctactcttgatcgagcgttgtaccctggggagtatatgattgaactcgtgttacaggtaaatgatcacatattgcgtgcacctgcaactcgtttgtggatccctcattcttcgcaagaggaaagtctgcaactgcaagtctcggttcaaacggcctaa

SEQ ID NO: 241 - protein, 350 aa, Clostridium sp. L2-50
AIEVQHISKSFKISYDKSKTLKDKIIFAKKDKYEIHQVLDDVSFTIEKGEAVGLIGHNGCGKSTTLKLLTRIIYPDSGEISIDGRVSSLLELGAGFHPDMTGRENIYTNASIFGLTKKEIDERLDEIIEFSELEEFIDNPVRTYSSGMYMRLAFSVAINVNADILLIDEILAVGDSNFQLKCANKMQELKKEGITIVIVSHSMGQIEELCDRCIWLDKGKIVSDGTPQYVHKLYMEFMGQARAERSEKERQLMEEAKNLDLSITKVECKNNAGEPRVAFSIDDDINITLYYKIKSPRKVAVQFTVFRSDYMMCYERRTDAEKGTVLLEGEGKIQLKLRKVQLLLGHYMID

SEQ ID NO: 242 - protein, 262 aa, Clostridium bolteae ATCC BAA-613
AENAIEVHDIKKSFRVYLDKGRTLKELVLFSKRRKYEERQVLQGISFEVKKGEALGLIGHNGCGKSTTLKLLTRIMYPDSGTIEMRGRVSSLIELGAGFHPDMSGRQNIYTNASIFGLTRKEIDARVDNIIEFSELEAFIDNPVRTYSSGMYMRLAFAVAINVDADILLVDEILAVGDANFQAKCFNKLREIKANGTTIVIVSHSLGQIEEICERSIWIHEGKIQKEGNPREVHPAYLEYMGQKRPEAASEKVKSEGERPGD

SEQ ID NO: 243 - protein, 275 aa, Clostridium bolteae ATCC BAA-613
AIDVAEVTKVYRLYEKPIDRLKESMSISHKNYHRDFYALNQLSFRVRKGETVGIIGTNGSGKSTILKIITGVLTPTTGEVKVDGKISALLELGAGFNMDYTGIENIYMNGTMMGYTKKEMDAKLQDILEFAEIGDFVYQPVKTYSSGMFVRLAFALAINVDPEILIVDEALSVGDVFFQSKCYRRMEEIRQKGTTILMVTHDMGSIIKYCDRVVLLNKGEFIAEGPAGRVVDMYKKILAGQLDALKAELERERQQKESLTGEIGQEDAGSGVLTG

SEQ ID NO: 244 - protein, 242 aa, Vibrio cholerae MZO-2
ACIEVKDISKCFQIYNKPSDRLKQFIVPKLPLIGKKYNCFYKEFWALKNISVEIKEGEVVGIIGQNGAGKSTLLQLICGTLHQTTGEVIKRGRISALLELGSGFNPEYSGRENVYLNASILGLSKKEIDEKFEDIEKFADIGSFIDQPVKSYSSGMYVRLAFSVAIHVEPSILIVDEALAVGDIRFQTKCLRAIDELKKGGTSIIFVTHSSGQIEALCDRVLWLHKGELLVSGEPSKVMRHY

SEQ ID NO: 245 - protein, 294 aa, Actinomyces odontolyticus ATCC 17982
TNAISVEGVSKRFRIYKNRNQSLKGAFLQRSRAQFEEFWALDDVSFEIPQGKTFGLLGHNGSGKSTLLKCIAKILTPDRGTISSTGRMAAMLEVGSGFHPELSGRENIYLNGAILGMSKKEIDSKLDAIIDFSGVERFIDQPVKNYSSGMYVRLGFSVSIHVEPDILLVDEVLAVGDMEFQNKCMDKFAQLKDQGRTVVVVSHGLEQMRTFCDQAAWLDHGTLVDVGAAAEVIDTYSDVAHHAVEVEGGGTRFGSGEAMIERIELLSASGQPTSLVYPGDPVRLRLHYRANERI

SEQ ID NO: 246 - protein, 392 aa, Artificial
  Substituion in SEQ ID NO 239
MATSAIEVCNVTKSFRVHIGKNQTLKEKLFYMGKSKYRDFIALKDVSVRIPKGATVGLIGMNGSGKSTLLKLISRIIYPDKGEIRVHGRVSSLLELGAGFHPEFTGLENIYMNAAILGLSKREVDKKLAEIVEFSELGDFLNEPVRSYSSGMYMRLAFSVAVAVDPEILLVDEVLAVGDAAFQEKCIERVRRLRREGKTIVIVTHDTGVVEQLCDHVVWLHNSRVRMEGRPEECIPHYLDEILGERRGTGMSFDRVEQPPLQPGDELKDLGLGLRVGIRENAEVLPNDGGIRVVYEASAAHEVCCEASVVIRRLGDPQELRPRCNEKIALPKGHSVLELHATLDRALYPGEYMIELVLQVNDHILRAPATRLWIPHSSQEESLQLQVSVQTA

SEQ ID NO: 247 - protein, 392 aa, Artificial
  Substituion in SEQ ID NO 239
MATSAIEVCNVTKSFRVHIGKNQTLKEKLFYMGKSKYRDFIALKDVSVRIPKGATVGLIGMNGSGKSTLLKLISRIIYPDKGEIRVHGRVSSLLELGAGFHPEFTGLENIYMNAAILGLSKREVDKKLAEIVEFSELGDFLNEPVRSYSSGMYMRLAFSVAVAVDPEILLVDEVLAVGDAAFQEKCLERVRRLRREGKTIVIVTHDTGVVEQLCDHVVWLHNSRVRMEGRPEECIPHYLDEILGERRGTGMSFDRVEQPPLQPGEELKDLGLGLRVGIRENAEVLPNDGGIRVVYEASAAHEVCCEASVVIRRLGDPQELRPRCNEKIALPKGHSVLELHATLDRALYPGEYMIELVLQVNDHILRAPATRLWIPHSSQEESLQLQVSVQTA

SEQ ID NO: 248 - protein, 392 aa, Artificial
  Substituion in SEQ ID NO 239
MATSAIEVCNVTKSFRVHIGKNQTLKEKLFYMGKSKYRDFIALKDVSVRIPKGATVGLIGMNGSGKSTLLKLISRIIYPDKGEIRVHGRVSSLLELGAGFHPEFTGLENIYMNAAILGLSKREVDKKLAEIVEFSELGDFLNEPVRSYSSGMYMRLAFSVAVAVDPEILLVDEVLAVGDAAFQEKCLERVRRLRREGKTIVIVTHDTGVVEQLCDHVVWLHNSRVRMEGRPEECIPHYLDEILGERRGTGMSFDRVEQPPLQPGDELKDLGLGLRVGIREQAEVLPNDGGIRVVYEASAAHEVCCEASVVIRRLGDPQELRPRCNEKIALPKGHSVLELHATLDRALYPGEYMIELVLQVNDHILRAPATRLWIPHSSQEESLQLQVSVQTA

SEQ ID NO: 249 - protein, 392 aa, Artificial
  Substituion in SEQ ID NO 239
MATSAIEVCNVTKSFRVHIGKNQTLKEKLFYMGKSKYRDFIALKDVSVRIPKGATVGLIGMNGSGKSTLLKLISRIIYPDKGEIRVHGRVSSLLELGAGFHPEFTGLENIYMNAAILGLSKREVDKKLAEIVEFSELGDFLNEPVRSYSSGMYMRLAFSVAVAVDPEILLVDEVLAVGDAAFQEKCLERVRRLRREGKTIVIVTHDTGVVEQLCDHVVWLHNSRVRMEGRPEECIPHYLDEILGERRGTGMSFDRVEQPPLQPGDELKDLGLGLRVGIRENAEVLPNDGGIRVVYEASAAHEVCCEASVVIRRLGDPQELRPRCNEKIALPKGHSVLELHATLDRALYPGDYMIELVLQVNDHILRAPATRLWIPHSSQEESLQLQVSVQTA

SEQ ID NO: 250 - protein, 392 aa, Artificial
  Substituion in SEQ ID NO 239
MATSAIEVCNVTKSFRVHIGKNQTLKEKLFYMGKSKYRDFIALKDVSVRIPKGATVGLIGMNGSGKSTLLKLISRIIYPDKGEIKVHGRVSSLLELGAGFHPEFTGLENIYMNAAILGLSKREVDKKLAEIVEFSELGDFLNEPVRSYSSGMYMRLAFSVAVAVDPEILLVDEVLAVGDAAFQEKCLERVRRLRREGKTIVIVTHDTGVVEQLCDHVVWLHNSRVRMEGRPEECIPHYLDEILGERRGTGMSFDRVEQPPLQPGDELKDLGLGLRVGIRENAEVLPNDGGIRVVYEASAAHEVCCEASVVIRRLGDPQELRPRCNEKIALPKGHSVLELHATLDRALYPGEYMIELVLQVNDHILRAPATRLWIPHSSQEESLQLQVSVQTA

SEQ ID NO: 251 - DNA, 1179 bp, Artificial
  Substituion in SEQ ID NO 240
atggccacaagtgctattgaggtatgcaatgtcaccaagtcgtttcgtgtccatattgggaaaaatcagacgttaaaagaaaaattgttctacatggggaagagcaagtatcgagattttatcgcgctcaaagacgtgtccgtgcgaattcccaaaggagccaccgttggactcattggcatgaacggttcaggtaagagtacgctcttaaaactgatatctcgcattatatatccagataaaggggaaattcgtgttcacggacgggtttctagcttactggagcttggtgcaggctttcatccggagtttacggggttagagaacatctatatgaatgcagccatactgggattgtcaaagcgcgaggtggacaagaagctggccgagatcgtcgagttctctgagttaggtgattttctgaatgagcccgttcgaagctactcgtcgggtatgtacatgaggctcgccttctctgtcgcggtcgcggtggatccggaaattttgctcgtggacgaagtattagcggtgggagacgctgcttttcaggagaaatgcattgaacgtgtccgcaggttgagaagagagggaaagacgatcgtcattgtcacacacgacacgggagtcgtggaacaattgtgcgatcacgtggtctggttacataactcgcgcgttcgaatggaagggcggccggaggaatgtatcccacattatctagacgaaatcctaggagagcgtaggggaacgggcatgtcgtttgaccgagtggaacaaccacctttgcaacccggcgatgaactgaaggacttgggtttgggattacgtgtcggcattcgagaaaatgccgaagttcttccgaacgacggcgggattcgggtcgtctacgaggcgtcggccgcgcatgaggtctgctgtgaggcgagcgtcgtgattcggcgtcttggcgacccacaagaacttcggcctaggtgcaacgaaaagatcgcattgcctaaggggcattcagttcttgagttgcatgctactcttgatcgagcgttgtaccctggggagtatatgattgaactcgtgttacaggtaaatgatcacatattgcgtgcacctgcaactcgtttgtggatccctcattcttcgcaagaggaaagtctgcaactgcaagtctcggttcaaacggcctaa

SEQ ID NO: 252 - DNA, 1179 bp, Artificial
  Substituion in SEQ ID NO 240
atggccacaagtgctattgaggtatgcaatgtcaccaagtcgtttcgtgtccatattgggaaaaatcagacgttaaaagaaaaattgttctacatggggaagagcaagtatcgagattttatcgcgctcaaagacgtgtccgtgcgaattcccaaaggagccaccgttggactcattggcatgaacggttcaggtaagagtacgctcttaaaactgatatctcgcattatatatccagataaaggggaaattcgtgttcacggacgggtttctagcttactggagcttggtgcaggctttcatccggagtttacggggttagagaacatctatatgaatgcagccatactgggattgtcaaagcgcgaggtggacaagaagctggccgagatcgtcgagttctctgagttaggtgattttctgaatgagcccgttcgaagctactcgtcgggtatgtacatgaggctcgccttctctgtcgcggtcgcggtggatccggaaattttgctcgtggacgaagtattagcggtgggagacgctgcttttcaggagaaatgccttgaacgtgtccgcaggttgagaagagagggaaagacgatcgtcattgtcacacacgacacgggagtcgtggaacaattgtgcgatcacgtggtctggttacataactcgcgcgttcgaatggaagggcggccggaggaatgtatcccacattatctagacgaaatcctaggagagcgtaggggaacgggcatgtcgtttgaccgagtggaacaaccacctttgcaacccggcgaagaactgaaggacttgggtttgggattacgtgtcggcattcgagaaaatgccgaagttcttccgaacgacggcgggattcgggtcgtctacgaggcgtcggccgcgcatgaggtctgctgtgaggcgagcgtcgtgattcggcgtcttggcgacccacaagaacttcggcctaggtgcaacgaaaagatcgcattgcctaaggggcattcagttcttgagttgcatgctactcttgatcgagcgttgtaccctggggagtatatgattgaactcgtgttacaggtaaatgatcacatattgcgtgcacctgcaactcgtttgtggatccctcattcttcgcaagaggaaagtctgcaactgcaagtctcggttcaaacggcctaa

SEQ ID NO: 253 - DNA, 1179 bp, Artificial
  Substituion in SEQ ID NO 240
atggccacaagtgctattgaggtatgcaatgtcaccaagtcgtttcgtgtccatattgggaaaaatcagacgttaaaagaaaaattgttctacatggggaagagcaagtatcgagattttatcgcgctcaaagacgtgtccgtgcgaattcccaaaggagccaccgttggactcattggcatgaacggttcaggtaagagtacgctcttaaaactgatatctcgcattatatatccagataaaggggaaattcgtgttcacggacgggtttctagcttactggagcttggtgcaggctttcatccggagtttacggggttagagaacatctatatgaatgcagccatactgggattgtcaaagcgcgaggtggacaagaagctggccgagatcgtcgagttctctgagttaggtgattttctgaatgagcccgttcgaagctactcgtcgggtatgtacatgaggctcgccttctctgtcgcggtcgcggtggatccggaaattttgctcgtggacgaagtattagcggtgggagacgctgcttttcaggagaaatgccttgaacgtgtccgcaggttgagaagagagggaaagacgatcgtcattgtcacacacgacacgggagtcgtggaacaattgtgcgatcacgtggtctggttacataactcgcgcgttcgaatggaagggcggccggaggaatgtatcccacattatctagacgaaatcctaggagagcgtaggggaacgggcatgtcgtttgaccgagtggaacaaccacctttgcaacccggcgatgaactgaaggacttgggtttgggattacgtgtcggcattcgagaacaagccgaagttcttccgaacgacggcgggattcgggtcgtctacgaggcgtcggccgcgcatgaggtctgctgtgaggcgagcgtcgtgattcggcgtcttggcgacccacaagaacttcggcctaggtgcaacgaaaagatcgcattgcctaaggggcattcagttcttgagttgcatgctactcttgatcgagcgttgtaccctggggagtatatgattgaactcgtgttacaggtaaatgatcacatattgcgtgcacctgcaactcgtttgtggatccctcattcttcgcaagaggaaagtctgcaactgcaagtctcggttcaaacggcctaa

SEQ ID NO: 254 - DNA, 1179 bp, Artificial
  Substituion in SEQ ID NO 240
atggccacaagtgctattgaggtatgcaatgtcaccaagtcgtttcgtgtccatattgggaaaaatcagacgttaaaagaaaaattgttctacatggggaagagcaagtatcgagattttatcgcgctcaaagacgtgtccgtgcgaattcccaaaggagccaccgttggactcattggcatgaacggttcaggtaagagtacgctcttaaaactgatatctcgcattatatatccagataaaggggaaattcgtgttcacggacgggtttctagcttactggagcttggtgcaggctttcatccggagtttacggggttagagaacatctatatgaatgcagccatactgggattgtcaaagcgcgaggtggacaagaagctggccgagatcgtcgagttctctgagttaggtgattttctgaatgagcccgttcgaagctactcgtcgggtatgtacatgaggctcgccttctctgtcgcggtcgcggtggatccggaaattttgctcgtggacgaagtattagcggtgggagacgctgcttttcaggagaaatgccttgaacgtgtccgcaggttgagaagagagggaaagacgatcgtcattgtcacacacgacacgggagtcgtggaacaattgtgcgatcacgtggtctggttacataactcgcgcgttcgaatggaagggcggccggaggaatgtatcccacattatctagacgaaatcctaggagagcgtaggggaacgggcatgtcgtttgaccgagtggaacaaccacctttgcaacccggcgatgaactgaaggacttgggtttgggattacgtgtcggcattcgagaaaatgccgaagttcttccgaacgacggcgggattcgggtcgtctacgaggcgtcggccgcgcatgaggtctgctgtgaggcgagcgtcgtgattcggcgtcttggcgacccacaagaacttcggcctaggtgcaacgaaaagatcgcattgcctaaggggcattcagttcttgagttgcatgctactcttgatcgagcgttgtaccctggggattatatgattgaactcgtgttacaggtaaatgatcacatattgcgtgcacctgcaactcgtttgtggatccctcattcttcgcaagaggaaagtctgcaactgcaagtctcggttcaaacggcctaa

SEQ ID NO: 255 - DNA, 1179 bp, Artificial
  Substituion in SEQ ID NO 240
atggccacaagtgctattgaggtatgcaatgtcaccaagtcgtttcgtgtccatattgggaaaaatcagacgttaaaagaaaaattgttctacatggggaagagcaagtatcgagattttatcgcgctcaaagacgtgtccgtgcgaattcccaaaggagccaccgttggactcattggcatgaacggttcaggtaagagtacgctcttaaaactgatatctcgcattatatatccagataaaggggaaattaaagttcacggacgggtttctagcttactggagcttggtgcaggctttcatccggagtttacggggttagagaacatctatatgaatgcagccatactgggattgtcaaagcgcgaggtggacaagaagctggccgagatcgtcgagttctctgagttaggtgattttctgaatgagcccgttcgaagctactcgtcgggtatgtacatgaggctcgccttctctgtcgcggtcgcggtggatccggaaattttgctcgtggacgaagtattagcggtgggagacgctgcttttcaggagaaatgccttgaacgtgtccgcaggttgagaagagagggaaagacgatcgtcattgtcacacacgacacgggagtcgtggaacaattgtgcgatcacgtggtctggttacataactcgcgcgttcgaatggaagggcggccggaggaatgtatcccacattatctagacgaaatcctaggagagcgtaggggaacgggcatgtcgtttgaccgagtggaacaaccacctttgcaacccggcgatgaactgaaggacttgggtttgggattacgtgtcggcattcgagaaaatgccgaagttcttccgaacgacggcgggattcgggtcgtctacgaggcgtcggccgcgcatgaggtctgctgtgaggcgagcgtcgtgattcggcgtcttggcgacccacaagaacttcggcctaggtgcaacgaaaagatcgcattgcctaaggggcattcagttcttgagttgcatgctactcttgatcgagcgttgtaccctggggagtatatgattgaactcgtgttacaggtaaatgatcacatattgcgtgcacctgcaactcgtttgtggatccctcattcttcgcaagaggaaagtctgcaactgcaagtctcggttcaaacggcctaa

SEQ ID NO: 256 - protein, 281 aa, Alicyclobacillus acidocaldarius
MTGTIRTRRGIVLAHAVLVIIGFFLIYPVLWMVFGSFKPTNEIFSSASFWPKHWTFANYPQGWNAIPGLPFGTFILHSLSVSCLVSVGTVISSAIVAFGFARFTFRGKSILFGIMMITMMLPTQVTLIPQYAMFHDLGWINTYYPLIVPAFFGSPFFIFLIVQFIRGLPKELDEAAKIDGCNAFTLFVRVILPLIVPALITTAIFSFIWCWDDFFSQLIYLNSAQKFTVPLGLESLANAVAQEEWGPLFAMSTVSLIPLFLIFFFLQKYVVRGIATTGLRG

SEQ ID NO: 257 - DNA, 846 bp, Alicyclobacillus acidocaldarius
gtgaccggaaccatccgcacgcggcgcggaatcgtcctcgcgcacgccgtgctcgtgatcatcggattctttctcatctatcccgttctctggatggtgtttggctcattcaagccgaccaacgagatcttctccagcgcctcgttttggcccaagcactggacgttcgcgaattatccgcaaggttggaatgcgattcctggccttccgtttgggacgttcatcctgcattcgctgtcggtgtcatgtctggtgtctgtcggcacggtcatctcgtccgcgattgtcgcgttcgggttcgcgcgtttcacgttccgaggcaaatccattctgtttggcatcatgatgatcacgatgatgctgccgacgcaggtcacgctcattccccagtacgcgatgtttcacgatctgggctggatcaatacctactatccgctcattgtgcccgcgttctttggcagcccgtttttcatctttctcatcgttcaattcatccgggggttgcccaaagaattggacgaggccgcgaagatcgacggctgcaacgccttcacgctgtttgtgcgcgtcatcctgccgctcatcgtgccggcgctcatcaccacggccatcttcagcttcatctggtgctgggatgacttcttctctcagttgatttaccttaattccgcgcagaagttcaccgtgccgctcgggctggagtcgctcgcgaacgccgtcgcgcaggaggagtgggggccgctcttcgccatgtccaccgtgtcgctcattccgctcttcctcatcttcttcttccttcagaagtacgtcgtccgcggcatcgccaccacgggcctgcgcggctga

SEQ ID NO: 258 - protein, 277 aa, Bacillus clausii KSM-K16
RTKTADAIYYTFVILFGFVMLYPILWMVASSLKPQTEIFGNAASLWPGEFMWENYAKGWEGFGRTGFDVYFSNSIFITTLSVIGAILSSSIVAYGFARLQFRFKKILFACLLGTVMLPVQITLIPQYIMFHNIGWVNTFYPLIVPAFLGGTPFFIFLLIQFIRGIPRELDEAAIIDGCSTFGIFWRIILPLIKPALVTVAIFAFMWAWDDFLAPLIYLNSADIQTVSLGLRNFMDAEGGTSWGPLLAMSTLSLLPQFIIFLFFQKHLVEGIATTGLK

SEQ ID NO: 259 - protein, 279 aa, Bacillus halodurans C-125
TKRTWYADVIYYGFVIAFGFIMVYPILWMVASSLKPASEIFSQASSLIPSEFVWSNYPDGWAGFGRTGFDIYFKNSFIITTSVVIGAILSSSIVAYGFARLQFKFKKVLFACLIATVMLPVQITLIPQYILFHNLGWVNTFYPLIVPAFLGGTPFFIFLLIQFIRGIPRELDEAAIIDGCSTFGVFWRVILPLLKPALVTVAIFAFMWTWDDFLAPLIYLNKTDIQTVALGLRNFMDAESGTSWGALLAMSTLSLLPQFIIFLFFQRYLVEGISTTGLK

SEQ ID NO: 260 - protein, 271 aa, Bacillus sp. NRRL B-14911
LLLHVIIIAIGLVMLYPLLWMVSSSFKEPTEIFKGVSFLPTNFNFDNYIEGWTGLSGVSFGRFFLNTFILVIFCTIGTVFSCSMAAYAFARLDFKFKKVLFGVMLVTMMLPFHVTVIPQYIMFNKLEWINTYIPLILPKFLAVDGFFIFLMVQFIRSIPKELDEAAKMDGCGPIRMFYTLIMPLALPAVITTVIFTFIWTWNDFFSQLLYLSDIKLYTVALGLRMFLDAMGQNSWGALFAMSTLSLIPLFIIFIFFQKYLIEGITAGGVKG

SEQ ID NO: 261 - protein, 273 aa, Clostridium bolteae ATCC BAA-613
GITIYHILVCIGGLIMVYPLIWMLMSSFKETNTIFATAKELLPEKATLVNYVNGWKGFAGSTFGRFFANSAIISVLSTVGAVASSAIVGYGFARCRFKGKKLLFTCMMVSMMLPFQVMMIPQFIWFKKLGWVGTYLPLIAPYFFGQGFFIFLIMQFIEGIPRELDEAAKIDGCSYYGVFRQIILPLIIPALITSGIFSFIWRWDDFMSPLLYINKTTMYPISYALKLFCDPSSTSDYGAMFAMATLSLLPAVIIFITLQKYLVEGIATSGIKG

SEQ ID NO: 262 - protein, 270 aa, Bacillus clausii KSM-K16
LYHFTVLLFGFFMLYPVLWMISSSVKPPAEIFQQAASLLPSAFHWDNYVEGWKGFGSVGFDQIFRNSLFVSSMNIIGALISSSFVAFGFARLKFPLKNILFACLIGTLMLPMQITLIPQYILFNYFGWVNTFLPLIVPAFVGGTPFFIFLMVQFIRGIPRELDEAAVIDGCSTLGIFWRIIMPLCKPVLVTVTIFAFLWSWDDFFGGLIYLNDPSLYTVGLGLASFLDSTSASSWGPLLAMATLSLVPQFIVFLFFQKYLVQGIATTGIK

SEQ ID NO: 263 - protein, 281 aa, Artificial
  Substituion in SEQ ID NO 256
MTGTIRTRRGIVLAHAVLVIIGFFLIYPVLWMVFGSFKPTNEIFSSASFWPKHWTFANYPQGWNAIPGLPFGTFILHSLSVSCLVSVGTVISSAIVAFGFARFTFRGKSILFGIMMITMMLPTQVTLIPQYAMFHDLGWINTYYPLIVPAFFGSPFFIFLIVQFIRGLPKELDEAAKIDGCNAFTIFVRVILPLIVPALITTAIFSFIWCWDDFFSQLIYLNSAQKFTVPLGLESLANAVAQEEWGPLFAMSTVSLIPLFLIFFFLQKYVVRGIATTGLRG

SEQ ID NO: 264 - protein, 281 aa, Artificial
  Substituion in SEQ ID NO 256
MTGTIRTRRGIVLAHAVLVIIGFFLIYPVLWMVFGSFKPTNEIFSSASFWPKHWTFANYPQGWNAIPGLPFGTFILHSLSVSCLVSVGTVISSAIVAFGFARFTFRGKSILFGIMMITMMLPTQVTLIPQYAMFHDLGWINTYYPLIVPAFFGSPFFIFLIVQFIRGLPKELDEAAKIDGCNAFTLFVRVILPLIVPALITTAIFSFIWCWDDFFSQLIYLNSAQKFTVPLGLESLANAIAQEEWGPLFAMSTVSLIPLFLIFFFLQKYVVRGIATTGLRG

SEQ ID NO: 265 - protein, 281 aa, Artificial
  Substituion in SEQ ID NO 256
MTGTIRTRRGIVLAHAVLVIIGFFLIYPVLWMVFGSFKPTNEIFSSASFWPKHWTFANYPQGWNAIPGLPFGTFILHSLSVSCLVSIGTVISSAIVAFGFARFTFRGKSILFGIMMITMMLPTQVTLIPQYAMFHDLGWINTYYPLIVPAFFGSPFFIFLIVQFIRGLPKELDEAAKIDGCNAFTLFVRVILPLIVPALITTAIFSFIWCWDDFFSQLIYLNSAQKFTVPLGLESLANAVAQEEWGPLFAMSTVSLIPLFLIFFFLQKYVVRGIATTGLRG

SEQ ID NO: 266 - protein, 281 aa, Artificial
  Substituion in SEQ ID NO 256
MTGTIRTRRGIVLAHAVLVIIGFFLIYPVLWMVFGSFKPTNEIFSSASFWPKHWTFANYPQGWNAIPGLPFGTFILHSLSVSCLVSVGTVISSAIVAFGFARFTFRGKSILFGLMMITMMLPTQVTLIPQYAMFHDLGWINTYYPLIVPAFFGSPFFIFLIVQFIRGLPKELDEAAKIDGCNAFTLFVRVILPLIVPALITTAIFSFIWCWDDFFSQLIYLNSAQKFTVPLGLESLANAVAQEEWGPLFAMSTVSLIPLFLIFFFLQKYVVRGIATTGLRG

SEQ ID NO: 267 - protein, 281 aa, Artificial
  Substituion in SEQ ID NO 256
MTGTIRTRRGIVLAHAVLVIIGFFLIYPVLWMIFGSFKPTNEIFSSASFWPKHWTFANYPQGWNAIPGLPFGTFILHSLSVSCLVSVGTVISSAIVAFGFARFTFRGKSILFGIMMITMMLPTQVTLIPQYAMFHDLGWINTYYPLIVPAFFGSPFFIFLIVQFIRGLPKELDEAAKIDGCNAFTLFVRVILPLIVPALITTAIFSFIWCWDDFFSQLIYLNSAQKFTVPLGLESLANAVAQEEWGPLFAMSTVSLIPLFLIFFFLQKYVVRGIATTGLRG

SEQ ID NO: 268 - DNA, 846 bp, Artificial
  Substituion in SEQ ID NO 257
gtgaccggaaccatccgcacgcggcgcggaatcgtcctcgcgcacgccgtgctcgtgatcatcggattctttctcatctatcccgttctctggatggtgtttggctcattcaagccgaccaacgagatcttctccagcgcctcgttttggcccaagcactggacgttcgcgaattatccgcaaggttggaatgcgattcctggccttccgtttgggacgttcatcctgcattcgctgtcggtgtcatgtctggtgtctgtcggcacggtcatctcgtccgcgattgtcgcgttcgggttcgcgcgtttcacgttccgaggcaaatccattctgtttggcatcatgatgatcacgatgatgctgccgacgcaggtcacgctcattccccagtacgcgatgtttcacgatctgggctggatcaatacctactatccgctcattgtgcccgcgttctttggcagcccgtttttcatctttctcatcgttcaattcatccgggggttgcccaaagaattggacgaggccgcgaagatcgacggctgcaacgccttcacgatttttgtgcgcgtcatcctgccgctcatcgtgccggcgctcatcaccacggccatcttcagcttcatctggtgctgggatgacttcttctctcagttgatttaccttaattccgcgcagaagttcaccgtgccgctcgggctggagtcgctcgcgaacgccgtcgcgcaggaggagtgggggccgctcttcgccatgtccaccgtgtcgctcattccgctcttcctcatcttcttcttccttcagaagtacgtcgtccgcggcatcgccaccacgggcctgcgcggctga

SEQ ID NO: 269 - DNA, 846 bp, Artificial
  Substituion in SEQ ID NO 257
gtgaccggaaccatccgcacgcggcgcggaatcgtcctcgcgcacgccgtgctcgtgatcatcggattctttctcatctatcccgttctctggatggtgtttggctcattcaagccgaccaacgagatcttctccagcgcctcgttttggcccaagcactggacgttcgcgaattatccgcaaggttggaatgcgattcctggccttccgtttgggacgttcatcctgcattcgctgtcggtgtcatgtctggtgtctgtcggcacggtcatctcgtccgcgattgtcgcgttcgggttcgcgcgtttcacgttccgaggcaaatccattctgtttggcatcatgatgatcacgatgatgctgccgacgcaggtcacgctcattccccagtacgcgatgtttcacgatctgggctggatcaatacctactatccgctcattgtgcccgcgttctttggcagcccgtttttcatctttctcatcgttcaattcatccgggggttgcccaaagaattggacgaggccgcgaagatcgacggctgcaacgccttcacgctgtttgtgcgcgtcatcctgccgctcatcgtgccggcgctcatcaccacggccatcttcagcttcatctggtgctgggatgacttcttctctcagttgatttaccttaattccgcgcagaagttcaccgtgccgctcgggctggagtcgctcgcgaacgccattgcgcaggaggagtgggggccgctcttcgccatgtccaccgtgtcgctcattccgctcttcctcatcttcttcttccttcagaagtacgtcgtccgcggcatcgccaccacgggcctgcgcggctga

SEQ ID NO: 270 - DNA, 846 bp, Artificial
  Substituion in SEQ ID NO 257
gtgaccggaaccatccgcacgcggcgcggaatcgtcctcgcgcacgccgtgctcgtgatcatcggattctttctcatctatcccgttctctggatggtgtttggctcattcaagccgaccaacgagatcttctccagcgcctcgttttggcccaagcactggacgttcgcgaattatccgcaaggttggaatgcgattcctggccttccgtttgggacgttcatcctgcattcgctgtcggtgtcatgtctggtgtctattggcacggtcatctcgtccgcgattgtcgcgttcgggttcgcgcgtttcacgttccgaggcaaatccattctgtttggcatcatgatgatcacgatgatgctgccgacgcaggtcacgctcattccccagtacgcgatgtttcacgatctgggctggatcaatacctactatccgctcattgtgcccgcgttctttggcagcccgtttttcatctttctcatcgttcaattcatccgggggttgcccaaagaattggacgaggccgcgaagatcgacggctgcaacgccttcacgctgtttgtgcgcgtcatcctgccgctcatcgtgccggcgctcatcaccacggccatcttcagcttcatctggtgctgggatgacttcttctctcagttgatttaccttaattccgcgcagaagttcaccgtgccgctcgggctggagtcgctcgcgaacgccgtcgcgcaggaggagtgggggccgctcttcgccatgtccaccgtgtcgctcattccgctcttcctcatcttcttcttccttcagaagtacgtcgtccgcggcatcgccaccacgggcctgcgcggctga

SEQ ID NO: 271 - DNA, 846 bp, Artificial
  Substituion in SEQ ID NO 257
gtgaccggaaccatccgcacgcggcgcggaatcgtcctcgcgcacgccgtgctcgtgatcatcggattctttctcatctatcccgttctctggatggtgtttggctcattcaagccgaccaacgagatcttctccagcgcctcgttttggcccaagcactggacgttcgcgaattatccgcaaggttggaatgcgattcctggccttccgtttgggacgttcatcctgcattcgctgtcggtgtcatgtctggtgtctgtcggcacggtcatctcgtccgcgattgtcgcgttcgggttcgcgcgtttcacgttccgaggcaaatccattctgtttggcttaatgatgatcacgatgatgctgccgacgcaggtcacgctcattccccagtacgcgatgtttcacgatctgggctggatcaatacctactatccgctcattgtgcccgcgttctttggcagcccgtttttcatctttctcatcgttcaattcatccgggggttgcccaaagaattggacgaggccgcgaagatcgacggctgcaacgccttcacgctgtttgtgcgcgtcatcctgccgctcatcgtgccggcgctcatcaccacggccatcttcagcttcatctggtgctgggatgacttcttctctcagttgatttaccttaattccgcgcagaagttcaccgtgccgctcgggctggagtcgctcgcgaacgccgtcgcgcaggaggagtgggggccgctcttcgccatgtccaccgtgtcgctcattccgctcttcctcatcttcttcttccttcagaagtacgtcgtccgcggcatcgccaccacgggcctgcgcggctga

SEQ ID NO: 272 - DNA, 846 bp, Artificial
  Substituion in SEQ ID NO 257
gtgaccggaaccatccgcacgcggcgcggaatcgtcctcgcgcacgccgtgctcgtgatcatcggattctttctcatctatcccgttctctggatgatttttggctcattcaagccgaccaacgagatcttctccagcgcctcgttttggcccaagcactggacgttcgcgaattatccgcaaggttggaatgcgattcctggccttccgtttgggacgttcatcctgcattcgctgtcggtgtcatgtctggtgtctgtcggcacggtcatctcgtccgcgattgtcgcgttcgggttcgcgcgtttcacgttccgaggcaaatccattctgtttggcatcatgatgatcacgatgatgctgccgacgcaggtcacgctcattccccagtacgcgatgtttcacgatctgggctggatcaatacctactatccgctcattgtgcccgcgttctttggcagcccgtttttcatctttctcatcgttcaattcatccgggggttgcccaaagaattggacgaggccgcgaagatcgacggctgcaacgccttcacgctgtttgtgcgcgtcatcctgccgctcatcgtgccggcgctcatcaccacggccatcttcagcttcatctggtgctgggatgacttcttctctcagttgatttaccttaattccgcgcagaagttcaccgtgccgctcgggctggagtcgctcgcgaacgccgtcgcgcaggaggagtgggggccgctcttcgccatgtccaccgtgtcgctcattccgctcttcctcatcttcttcttccttcagaagtacgtcgtccgcggcatcgccaccacgggcctgcgcggctga

SEQ ID NO: 273 - protein, 331 aa, Alicyclobacillus acidocaldarius
MTSLRTGPGAPPGHSGKRGDRVAVATTTKANVKAKGEAVKAVRPRNEKVAYLFLSPWMFGLVVFSLGPILVSLYLSFTNYNLLQPPKWIGLENYVHMFTQSQLFATSLVDTLEYILISVPIKMVVALAIALLLSLEVKGIGVYRTVYYVPSLIGTSVAVAYLWQQMFGPDGLINKGLALVGIHGPNWLAEPRTALFTLAMLQAWQFGSAMMIFVAGLKQIPESLYEAAIVDGAGRLYRFFRITIPMLSPVIFFNLIMSIINGFTQFTQGYIVTDGGPLNATLFFALYLYEEAFNFQNMGYASALAWFLLVLVGVLTFLVFRFGSRYVYYES

SEQ ID NO: 274 - DNA, 996 bp, Alicyclobacillus acidocaldarius
gtgacgtctctgaggacggggcccggcgcaccgccgggccattccggaaagcggggtgatcgcgtggctgtggcaaccacgaccaaggccaacgtgaaggcaaaaggtgaggccgtgaaggccgtgcggccgcgcaacgagaaggtcgcctatctgtttctgagcccatggatgttcggcctggtggtgttttcgctcgggcccatcctggtctcgctctatctgtccttcaccaattacaacttattgcagccgccgaaatggattggcctcgagaattacgtgcacatgttcacgcagagccagctgttcgccacttcgctggtggacacgctggagtacatcttgatctcggtgcccatcaagatggtggtcgccctcgccatcgccctgctcctcagtctcgaggtcaaggggattggcgtgtatcggaccgtctactacgttccgtcgctcatcggcacgagcgtcgccgtcgcgtacctgtggcaacaaatgtttgggcccgacggtctcatcaacaagggtctggcgctcgtcggcattcacgggcccaattggctcgccgaaccgcgcacggccctgttcaccctggctatgctgcaggcttggcagttcggttctgcgatgatgatcttcgtggcaggactgaagcagattcccgagtcgctgtatgaggccgccatcgtggacggcgcgggccggctgtaccggttctttcgcatcaccatccccatgttgtcgccagtcattttcttcaacctgatcatgtccatcatcaacgggttcacccagttcacgcagggatacatcgtcacggacggtgggccgctgaacgcgacgctgtttttcgcgctctacctgtacgaggaggcgtttaacttccagaacatgggctacgcgtcggcgctggcctggttcctcttggtcctggtgggcgtgctgacgttcttggtgttcaggttcggaagtcgctacgtgtattacgagtcctga

SEQ ID NO: 275 - protein, 268 aa, Arthrobacter aurescens TC1
KKANGRDNKAAYIFLLPWLVGLVAITVGPMLMSLYLSFTDYNLLQPPEWVGLDNFIRMFGDARLHNSLRVTFTYVLVGVPLQLGVALLIALVLDKGLRGLPFYRSIFYLPSLLGGSVAVAILWKQIFGTTGLVNQILAMVGIEGPGWISDPNTALGSIILLHVWTFGSPMIIFLAGLRQIPVMYYEAAKVDGATTLQQFWRITLPMLSPIIFFNLVLQIIGSFQSFTQAFIVSGGNGGPSDSTMFFTLYLYQKGFGQFDMGYASAMAW

SEQ ID NO: 276 - protein, 307 aa, Bacillus clausii KSM-K16
ETIRAEYPPNRKTSAKWRVWKQYLVGFAFISPWLVGFLGFVIGPMIASLYYSFTDFDMLTSPNWVGLDNYITMFTNDPRFRTSITVTLVFVFVSTPIKLAFALLIAMLFNNKRKGSGFYTTLFYIPSIIGGSVAVAVMWRQLFGGQGAINDILLFFGVEGKSWIASPDHALMVLILLVIWQFGSPMIIFLAGLRQIPEDLYEAASVDGAGKFRKFLSITIPLLTPVIFFNLIMQMIGAFLVFTQAFVTTQGGPLDRTLFYALYLYERAFTNYEMGYASAMAWTLLIVIAIVTGLLFYSSKKWVFYES

SEQ ID NO: 277 - protein, 263 aa, Kineococcus radiotolerans SRS30216
RQGRAAHVFLIPWLLGLVLITAVPLLASLYLAFTDYDLLNAPTWTGLENFRRMGEDPRFWASTWVTLKYVVVSVPLQLAFALALAVVLDKGIKGLALYRSVYYLPSLLGTSVAVAILWRQLFGHDGLINAGLALLGVEGQSWLQNPATALSTIVVLNVWTFGSPMIIFLAGLRQIPEELYEAARVDGAGRWRQFVSITAPMLTPIIFFNLVLQTIGAFQSFTQAHVISGGRGGPLDSTLFYTLYLYQQGFVNFNMGYASAMAW

SEQ ID NO: 278 - protein, 268 aa, Arthrobacter sp. FB24
KKANGRDNKAAYIFLLPWLVGLVAITIGPMLMSLYLSFTDYNLLQPPEWTGLDNFTRMLSDARLHNSLRVTFTYVFVGVPLQLAVALLIALVLDKGLRGLPFYRSVFYLPSLLGGSVAVAILWKQIFGTTGLVNQVLAMFGVQGPGWISDPSTALGSIILLHVWTFGAPMIIFLAGLRQIPVMYYEAAKVDGASTLQQFRRITMPMLSPIIFFNLVLQIIGSFQSFTQAFIVSGGNGGPSDSTMFFTLYLYQKGFGQFDMGYASAMAW

SEQ ID NO: 279 - protein, 283 aa, Bacillus sp. NRRL B-14911
VGYFFLTPWLIGLIGLSVIPMAASLYFSFTSYDMFTAPEWIGLSNYIEMFNDAKWLKSVKVTLIYVFLGVPLQLAFALGVAVLLNRGLKGLQVYRAIYYVPSLFGGSVAIALLWRQLFGGEGLINKVLALVGIEGQNWISSPDTALYTLIILTIWQFGAPMVIFLAGLKQVPVELYESSLIDGAGPVKQFFSITLPLITPIIFFNLVMQIISAFQAFTPAYIVSGGKGGPLDSTLFYTLYLYQKGFTQFQMGYASAMAWFLLACISVVTAIVFISSKKWVYYQ

SEQ ID NO: 280 - protein, 331 aa, Artificial
  Substituion in SEQ ID NO 273
MTSLRTGPGAPPGHSGKRGDRVAVATTTKANIKAKGEAVKAVRPRNEKVAYLFLSPWMFGLVVFSLGPILVSLYLSFTNYNLLQPPKWIGLENYVHMFTQSQLFATSLVDTLEYILISVPIKMVVALAIALLLSLEVKGIGVYRTVYYVPSLIGTSVAVAYLWQQMFGPDGLINKGLALVGIHGPNWLAEPRTALFTLAMLQAWQFGSAMMIFVAGLKQIPESLYEAAIVDGAGRLYRFFRITIPMLSPVIFFNLIMSIINGFTQFTQGYIVTDGGPLNATLFFALYLYEEAFNFQNMGYASALAWFLLVLVGVLTFLVFRFGSRYVYYES

SEQ ID NO: 281 - protein, 331 aa, Artificial
  Substituion in SEQ ID NO 273
MTSLRTGPGAPPGHSGKRGDRVAVATTTKANVKAKGEAVKAVRPRNEKVAYLFLSPWMFGLVVFSLGPILVSLYLSFTNYNLLQPPKWIGLENYVHMFTQSQLFATSLVDTLEYILISVPIKMVVALAIALLLSLEVKGIGVYRTVYYVPSLIGTSVAVAYLWQQMFGPDGLINKGLALVGIHGPNWLAEPRTALFTLAMLQAWQFGSAMMIFVAGLRQIPESLYEAAIVDGAGRLYRFFRITIPMLSPVIFFNLIMSIINGFTQFTQGYIVTDGGPLNATLFFALYLYEEAFNFQNMGYASALAWFLLVLVGVLTFLVFRFGSRYVYYES

SEQ ID NO: 282 - protein, 331 aa, Artificial
  Substituion in SEQ ID NO 273
MTSLRTGPGAPPGHSGKRGDRVAVATTTKANVKAKGEAVKAVRPRNEKVAYLFLSPWMFGLVVFSLGPILVSLYLSFTNYNLLQPPKWIGLENYVHMFTQSQLFATSLVDTLEYILISVPIKMVVALAIALLLSLEVKGIGVYRTVYYVPSLIGTSVAVAYLWQQMFGPDGLINKGLALVGIHGPNWLAEPRTALFTLAMLQAWQFGSAMMIFVAGLKQIPESLYEAAIVDGAGRLYRFFRITIPMLSPVIFFNLIMSIINGFTQFTQGYIVTDGGPLNATLFFALYLYEEAFNFQNMGYASALAWFLLVLVGVLTFLVFRFGSRYIYYES

SEQ ID NO: 283 - protein, 331 aa, Artificial
  Substituion in SEQ ID NO 273
MTSLRTGPGAPPGHSGKRGDRVAVATTTKANVKAKGEAVKAVRPRNEKVAYLFLSPWMFGLVVFSLGPILVSLYLSFTNYNLLQPPKWIGLENYVHMFTQSQLFATSLVDTLEYILISVPIKMVVALAIALLLSLEVKGIGVYRTVYYVPSLIGTSVAVAYLWQQMFGPDGLINKGLALVGIHGPNWLAEPRTALFTLAMLQAWQFGSAMMIFVAGLKQIPESLYEAAIVDGAGRLYRFFRITIPMLSPVIFFNLIMSIINGFTQFTQGYIVTDGGPLNATLFFALYLYEEAFNFQNMGYASALAWFLLVLVGVLTFLIFRFGSRYVYYES

SEQ ID NO: 284 - protein, 331 aa, Artificial
  Substituion in SEQ ID NO 273
MTSLRTGPGAPPGHSGKRGDRVAVATTTKANVKAKGEAVKAVRPRNEKVAYLFLSPWMFGLVVFSLGPILVSLYLSFTNYNLLQPPKWIGLENYVHMFTQSQLFATSLVDTLEYILISIPIKMVVALAIALLLSLEVKGIGVYRTVYYVPSLIGTSVAVAYLWQQMFGPDGLINKGLALVGIHGPNWLAEPRTALFTLAMLQAWQFGSAMMIFVAGLKQIPESLYEAAIVDGAGRLYRFFRITIPMLSPVIFFNLIMSIINGFTQFTQGYIVTDGGPLNATLFFALYLYEEAFNFQNMGYASALAWFLLVLVGVLTFLVFRFGSRYVYYES

SEQ ID NO: 285 - DNA, 996 bp, Artificial
  Substituion in SEQ ID NO 274
gtgacgtctctgaggacggggcccggcgcaccgccgggccattccggaaagcggggtgatcgcgtggctgtggcaaccacgaccaaggccaacattaaggcaaaaggtgaggccgtgaaggccgtgcggccgcgcaacgagaaggtcgcctatctgtttctgagcccatggatgttcggcctggtggtgttttcgctcgggcccatcctggtctcgctctatctgtccttcaccaattacaacttattgcagccgccgaaatggattggcctcgagaattacgtgcacatgttcacgcagagccagctgttcgccacttcgctggtggacacgctggagtacatcttgatctcggtgcccatcaagatggtggtcgccctcgccatcgccctgctcctcagtctcgaggtcaaggggattggcgtgtatcggaccgtctactacgttccgtcgctcatcggcacgagcgtcgccgtcgcgtacctgtggcaacaaatgtttgggcccgacggtctcatcaacaagggtctggcgctcgtcggcattcacgggcccaattggctcgccgaaccgcgcacggccctgttcaccctggctatgctgcaggcttggcagttcggttctgcgatgatgatcttcgtggcaggactgaagcagattcccgagtcgctgtatgaggccgccatcgtggacggcgcgggccggctgtaccggttctttcgcatcaccatccccatgttgtcgccagtcattttcttcaacctgatcatgtccatcatcaacgggttcacccagttcacgcagggatacatcgtcacggacggtgggccgctgaacgcgacgctgtttttcgcgctctacctgtacgaggaggcgtttaacttccagaacatgggctacgcgtcggcgctggcctggttcctcttggtcctggtgggcgtgctgacgttcttggtgttcaggttcggaagtcgctacgtgtattacgagtcctga

SEQ ID NO: 286 - DNA, 996 bp, Artificial
  Substituion in SEQ ID NO 274
gtgacgtctctgaggacggggcccggcgcaccgccgggccattccggaaagcggggtgatcgcgtggctgtggcaaccacgaccaaggccaacgtgaaggcaaaaggtgaggccgtgaaggccgtgcggccgcgcaacgagaaggtcgcctatctgtttctgagcccatggatgttcggcctggtggtgttttcgctcgggcccatcctggtctcgctctatctgtccttcaccaattacaacttattgcagccgccgaaatggattggcctcgagaattacgtgcacatgttcacgcagagccagctgttcgccacttcgctggtggacacgctggagtacatcttgatctcggtgcccatcaagatggtggtcgccctcgccatcgccctgctcctcagtctcgaggtcaaggggattggcgtgtatcggaccgtctactacgttccgtcgctcatcggcacgagcgtcgccgtcgcgtacctgtggcaacaaatgtttgggcccgacggtctcatcaacaagggtctggcgctcgtcggcattcacgggcccaattggctcgccgaaccgcgcacggccctgttcaccctggctatgctgcaggcttggcagttcggttctgcgatgatgatcttcgtggcaggactgcgtcagattcccgagtcgctgtatgaggccgccatcgtggacggcgcgggccggctgtaccggttctttcgcatcaccatccccatgttgtcgccagtcattttcttcaacctgatcatgtccatcatcaacgggttcacccagttcacgcagggatacatcgtcacggacggtgggccgctgaacgcgacgctgtttttcgcgctctacctgtacgaggaggcgtttaacttccagaacatgggctacgcgtcggcgctggcctggttcctcttggtcctggtgggcgtgctgacgttcttggtgttcaggttcggaagtcgctacgtgtattacgagtcctga

SEQ ID NO: 287 - DNA, 996 bp, Artificial
  Substituion in SEQ ID NO 274
gtgacgtctctgaggacggggcccggcgcaccgccgggccattccggaaagcggggtgatcgcgtggctgtggcaaccacgaccaaggccaacgtgaaggcaaaaggtgaggccgtgaaggccgtgcggccgcgcaacgagaaggtcgcctatctgtttctgagcccatggatgttcggcctggtggtgttttcgctcgggcccatcctggtctcgctctatctgtccttcaccaattacaacttattgcagccgccgaaatggattggcctcgagaattacgtgcacatgttcacgcagagccagctgttcgccacttcgctggtggacacgctggagtacatcttgatctcggtgcccatcaagatggtggtcgccctcgccatcgccctgctcctcagtctcgaggtcaaggggattggcgtgtatcggaccgtctactacgttccgtcgctcatcggcacgagcgtcgccgtcgcgtacctgtggcaacaaatgtttgggcccgacggtctcatcaacaagggtctggcgctcgtcggcattcacgggcccaattggctcgccgaaccgcgcacggccctgttcaccctggctatgctgcaggcttggcagttcggttctgcgatgatgatcttcgtggcaggactgaagcagattcccgagtcgctgtatgaggccgccatcgtggacggcgcgggccggctgtaccggttctttcgcatcaccatccccatgttgtcgccagtcattttcttcaacctgatcatgtccatcatcaacgggttcacccagttcacgcagggatacatcgtcacggacggtgggccgctgaacgcgacgctgtttttcgcgctctacctgtacgaggaggcgtttaacttccagaacatgggctacgcgtcggcgctggcctggttcctcttggtcctggtgggcgtgctgacgttcttggtgttcaggttcggaagtcgctacatttattacgagtcctga

SEQ ID NO: 288 - DNA, 996 bp, Artificial
  Substituion in SEQ ID NO 274
gtgacgtctctgaggacggggcccggcgcaccgccgggccattccggaaagcggggtgatcgcgtggctgtggcaaccacgaccaaggccaacgtgaaggcaaaaggtgaggccgtgaaggccgtgcggccgcgcaacgagaaggtcgcctatctgtttctgagcccatggatgttcggcctggtggtgttttcgctcgggcccatcctggtctcgctctatctgtccttcaccaattacaacttattgcagccgccgaaatggattggcctcgagaattacgtgcacatgttcacgcagagccagctgttcgccacttcgctggtggacacgctggagtacatcttgatctcggtgcccatcaagatggtggtcgccctcgccatcgccctgctcctcagtctcgaggtcaaggggattggcgtgtatcggaccgtctactacgttccgtcgctcatcggcacgagcgtcgccgtcgcgtacctgtggcaacaaatgtttgggcccgacggtctcatcaacaagggtctggcgctcgtcggcattcacgggcccaattggctcgccgaaccgcgcacggccctgttcaccctggctatgctgcaggcttggcagttcggttctgcgatgatgatcttcgtggcaggactgaagcagattcccgagtcgctgtatgaggccgccatcgtggacggcgcgggccggctgtaccggttctttcgcatcaccatccccatgttgtcgccagtcattttcttcaacctgatcatgtccatcatcaacgggttcacccagttcacgcagggatacatcgtcacggacggtgggccgctgaacgcgacgctgtttttcgcgctctacctgtacgaggaggcgtttaacttccagaacatgggctacgcgtcggcgctggcctggttcctcttggtcctggtgggcgtgctgacgttcttgattttcaggttcggaagtcgctacgtgtattacgagtcctga

SEQ ID NO: 289 - DNA, 996 bp, Artificial
  Substituion in SEQ ID NO 274
gtgacgtctctgaggacggggcccggcgcaccgccgggccattccggaaagcggggtgatcgcgtggctgtggcaaccacgaccaaggccaacgtgaaggcaaaaggtgaggccgtgaaggccgtgcggccgcgcaacgagaaggtcgcctatctgtttctgagcccatggatgttcggcctggtggtgttttcgctcgggcccatcctggtctcgctctatctgtccttcaccaattacaacttattgcagccgccgaaatggattggcctcgagaattacgtgcacatgttcacgcagagccagctgttcgccacttcgctggtggacacgctggagtacatcttgatctcgattcccatcaagatggtggtcgccctcgccatcgccctgctcctcagtctcgaggtcaaggggattggcgtgtatcggaccgtctactacgttccgtcgctcatcggcacgagcgtcgccgtcgcgtacctgtggcaacaaatgtttgggcccgacggtctcatcaacaagggtctggcgctcgtcggcattcacgggcccaattggctcgccgaaccgcgcacggccctgttcaccctggctatgctgcaggcttggcagttcggttctgcgatgatgatcttcgtggcaggactgaagcagattcccgagtcgctgtatgaggccgccatcgtggacggcgcgggccggctgtaccggttctttcgcatcaccatccccatgttgtcgccagtcattttcttcaacctgatcatgtccatcatcaacgggttcacccagttcacgcagggatacatcgtcacggacggtgggccgctgaacgcgacgctgtttttcgcgctctacctgtacgaggaggcgtttaacttccagaacatgggctacgcgtcggcgctggcctggttcctcttggtcctggtgggcgtgctgacgttcttggtgttcaggttcggaagtcgctacgtgtattacgagtcctga

SEQ ID NO: 290 - protein, 448 aa, Alicyclobacillus acidocaldarius
MKRGGIRMRKKRWTWTASAAAALVLAGCGTAAAQGGSSGSQAGQAAGSADSKPVVTLTFGFWGDAKEEAVTLAAVKAFEKAYPNIHIQTEFGGPFNQYFTKLSTEVAGGNAPDIMQMDYEYIDAYAKEGQLLNLKGAKGINISTISPSVLKSGYIDGGLYGIPNALNNYAVIYDEAAFAKAGYHGQRVSWQQWADILEKVHKATGKWAENDDESWQTFGYWARQHGQHLYNASGTKLGFTESTLVSYLNYWANLRKEGVVPPGTVTSLIKQTADPTDPMVQGKSDAELTWVNYVVSLQSEMTRSLALALPPTQPGGEEGLYIKPSQFWSIYSKTKYPQQAELFVNFLLNNVQAGKALGLVRGIPVSSSVRTQLMASGTSAPEKAEFQLVNEALKVATPIDPPPPQHDKEIDQDFANMVQAVQYGKETPQQGAEQFMQEANDLLQNGGE

SEQ ID NO: 291 - DNA, 1347 bp, Alicyclobacillus acidocaldarius
gtgaaacgaggaggaatccgcatgcgaaaaaagagatggacatggacggcgagcgccgcggctgcgctggtgttggcgggctgcggcaccgcggcggcgcagggcggttcgagtgggtcgcaagccgggcaggccgcgggaagcgcggactcgaagccggtggtcacgctcaccttcggcttctggggcgatgcgaaggaagaggcggtcacgctggccgcggtgaaagcgtttgagaaggcgtatccgaacattcacatccagaccgaattcggagggccattcaatcagtacttcacgaagctgtccaccgaggtcgcgggcggcaacgcaccagacatcatgcagatggattacgaatacattgacgcctacgccaaggaaggccagttgctcaacctgaagggcgcgaagggaatcaacatctccaccatcagcccgagcgtcctgaagagcggctacatcgacggcgggttgtatggcattccgaatgcgctgaataactatgcggtcatctacgacgaggccgcgtttgccaaggcgggctatcacggccaacgcgtttcatggcaacagtgggcggatatcctcgaaaaggtccataaggcgacaggcaagtgggccgagaacgacgacgagagctggcagacctttggatactgggcgcgccagcacggtcagcacctatacaacgcctccgggacgaagctcggatttaccgagagcacgctcgtctcctatctgaactactgggcgaatcttcgcaaagagggcgttgtgccgcccgggaccgtgacatccctcatcaagcagacggccgatccgacggatccgatggtgcaagggaaatcggatgcggaactcacctgggtcaactacgtcgtcagcctgcagagcgagatgacgcgaagcttggcgctggcccttccgccgacacagccgggtggagaggagggcctgtatatcaagccgagccagttctggagcatctattccaagacgaagtatccgcagcaagccgagctctttgtcaacttcttgctgaacaacgtccaagcgggcaaggcgctcgggctcgtgcgcggcatcccggtgtcgtcctccgtccgcactcagttgatggcatccggcacctcggcgcctgaaaaggccgagttccagctggtgaacgaggcgctcaaggtggccacgcccatcgatcctccgccgccgcagcacgacaaggagatcgaccaggacttcgcgaacatggtccaggctgtgcaatacggcaaggaaacgccccagcagggcgccgaacagtttatgcaggaggcgaacgatctcctgcagaacggcggcgagtga

SEQ ID NO: 292 - protein, 392 aa, Thermobifida fusca YX
VVELRFSWWGSDERHAMTQEVIELFEEQNPGIKIVGEYTDWASYWDKLATTTAAGDAPDIITQEERYLREYAERGALLDLSQLDGLDLSKIDPLVAESGDLDGATYGVATGVNAYAILADPQAFADAGVDMPDDDTWTWDDYVKIAAEISEKSNGEIVGTQAMGYNETGFAIFARQHGESLYTEDGKLGFSKKTLEKWFQYTVDLLESGAQPGASESVEIEAGGPDQSVLATNKGAMAHFWTNQLGAISASSGREIELLRYPGETEHERTGMYFKPAMYYSISAGTEHPEEAAKFVDFLLNSEEAAAILLADRGLPANVEVRESIVDALPEADRRSAEFLAEIEGTIVDGNPPPPIGAGQVVDIIKRINDDLMFGRLTPAEAADRFIKEVED

SEQ ID NO: 293 - protein, 393 aa, Bacillus halodurans C-125
VVLRVAWWGGQERHDMTIEAIELFEEKYPHIQVDPEFTSWDNYWERLTTQAAGNNLPDVIQMDNSKLNEYSSRGLVIDLQSLIADGTINLDDVDDVYQDMNVQDGSVWAVSAGSNALAAIYNEEMLEEQGIQLEPGYTYEDFYEAMQTLKENIDGDFYGYDFGNAEYEMFFVYARQNGESFYNEDGTGLGFENQTLIDFLTFVKQMVDDGVAPPHALTLEYIQGGESLLGDQMAGAAMAASNGIIGLQQSTEHQLGLMLLPSLDGGVHGNWIRPSMSYSISSHSEEQEAAALFIDFLTNDLQANEILKAERGVPISSKVREHLAPMVDGPIAKTFEFLELVADYTSPADPLPPPGESEVRGAFLRMIESVKYERLSIEEATEQFRQEAEQILR

SEQ ID NO: 294 - protein, 391 aa, Bacillus clausii KSM-K16
LRVAWWGGQERHTMTLEVIDLFEEKYPDISVEPEYTSWDNYWERLTTQAAGSNLPDVVQLDYTKMNEYISRNLLKDLAPLIEDGSIDLSNVDDVYQDVNTIDDAIYGISLGSNALGMLYNAELFAEHGIELDEGYTYEDMKASMLKLKSALGDGFYGYDFNNTEFDLFFAYARQNGESVFNETGDGLGYSDETLVSYFQFIQGMVEEEAAPPHELTMEYIQGGDSTIADGTTSMLLIASNQIIGQQALTEAELDLKPLPEMEGGTEGNWIRPSMSFAISEHTNQEEHAALFIDFITNDPEANEILQAERGVPISAEIRSHLEGKVSPEVEKTFAYLEYVAENSAPADPLPPPGESEVRAAFLRVVESLKYGQTTPEDGAEQFRQQAESILK

SEQ ID NO: 295 - protein, 392 aa, Bacillus clausii KSM-K16
LRVAWWGSQARHDRTIEAIKLFEAENPDIAITTEFTGWDGYWERMSTQAAGRNLPDVIQMDLQYINEYVSRDLLVDLTPYVEDGTLDFSDVDDIYLEGGIVNEGLYGINLGSNAMSIAYDAEIFAEAGVPELEPGYTWDDYIEAVKTIHENLDGMYAYGFGDSLNFFKHYLRQHDLWLYNEDNTGLGYDDDKYLIDFLNMYKDLLDSGVAAPPDVKAEVQGIQDELIVHGRASTFSPHSNQIVALNEAAGRKLQMTTLPAMEGGSEASFIKPSLLFSATSQGDKSEEAARFINFFVNSIEANEILNAERGVPISEKVRDHLYDHVSENTQLQFDYVQLVEQRAAPIHPPDPAGTGQILDLYARMIEEFEYELLSAEEFAERFRGEVEIILSN

SEQ ID NO: 296 - protein, 389 aa, Agrobacterium tumefaciens str. C58
WWGSQERADRTNKAISAYKQVKPDLDIAGEFAGWSDYWPRLATQVAGRNAPDLIQMDYRYIFEYGRRGALAPLDDYIGKGLKIEDFGKMNIDSGRVDGKLYGINLGVNSSAVFFDKAAWEKSGATPPATGQTWEEFAENAARLSKNKPKPGYYATADASGVEPSFENWLRQNGKSLYTQDGAIGFDPTDATKWFSLWADLRKSGACVPADVQALDQLNIETNPLTTGKAATAFAHSNQFVGYQKLNKSKLAISSYPKSKKDGPSGHYLKPSMLISVANGSAGIEQAVGFINFLVAEPEGIDILGVERGVPASESMRNALSSKLDEVSKIMVDYIAEITPGVGDLPPAPPPGAGEFAFVLKRTAEEVGFGKISPEEGGDRLVKESETVIK

SEQ ID NO: 297 - protein, 448 aa, Artificial
  Substituion in SEQ ID NO 290
MKRGGIRMRKKRWTWTASAAAALVLAGCGTAAAQGGSSGSQAGQAAGSADSKPVVTLTFGFWGDAKEEAVTLAAVKAFEKAYPNIHIQTEFGGPFNQYFTKLSTEVAGGNAPDIMQMDYEYIDAYAKEGQLLNLKGAKGINISTISPSVLKSGYIDGGLYGIPNALNNYAVIYDEAAFAKAGYHGQRVSWQQWADILEKVHKATGKWAENDDESWQTFGYWARQHGQHLYNASGTKLGFTESTLVSYLNYWANLRKEGVVPPGTVTSLIKQTADPTDPMVQGKSEAELTWVNYVVSLQSEMTRSLALALPPTQPGGEEGLYIKPSQFWSIYSKTKYPQQAELFVNFLLNNVQAGKALGLVRGIPVSSSVRTQLMASGTSAPEKAEFQLVNEALKVATPIDPPPPQHDKEIDQDFANMVQAVQYGKETPQQGAEQFMQEANDLLQNGGE

SEQ ID NO: 298 - protein, 448 aa, Artificial
  Substituion in SEQ ID NO 290
MKRGGIRMRKKRWTWTASAAAALVLAGCGTAAAQGGSSGSQAGQAAGSADSKPVVTLTFGFWGDAKEEAVTLAAVKAFEKAYPNIHIQTEFGGPFNQYFTKLSTEVAGGNAPDIMQMDYEYIDAYAKEGQLLNLKGAKGINISTISPSVLKSGYIDGGLYGIPNALNNYAVIYDEAAFAKAGYHGQRVSWQQWADILEKVHKATGKWAENEDESWQTFGYWARQHGQHLYNASGTKLGFTESTLVSYLNYWANLRKEGVVPPGTVTSLIKQTADPTDPMVQGKSDAELTWVNYVVSLQSEMTRSLALALPPTQPGGEEGLYIKPSQFWSIYSKTKYPQQAELFVNFLLNNVQAGKALGLVRGIPVSSSVRTQLMASGTSAPEKAEFQLVNEALKVATPIDPPPPQHDKEIDQDFANMVQAVQYGKETPQQGAEQFMQEANDLLQNGGE

SEQ ID NO: 299 - protein, 448 aa, Artificial
  Substituion in SEQ ID NO 290
MKRGGIRMRKKRWTWTASAAAALVLAGCGTAAAQGGSSGSQAGQAAGSADSKPVVTLTFGFWGDAKEEAVTLAAVKAFEKAYPNIHIQTEFGGPFNQYFTKLSTEVAGGNAPDIMQMDYEYIDAYAKEGQLLNLKGAKGINISTISPSVLKSGYIDGGLYGIPNALNNYAVLYDEAAFAKAGYHGQRVSWQQWADILEKVHKATGKWAENDDESWQTFGYWARQHGQHLYNASGTKLGFTESTLVSYLNYWANLRKEGVVPPGTVTSLIKQTADPTDPMVQGKSDAELTWVNYVVSLQSEMTRSLALALPPTQPGGEEGLYIKPSQFWSIYSKTKYPQQAELFVNFLLNNVQAGKALGLVRGIPVSSSVRTQLMASGTSAPEKAEFQLVNEALKVATPIDPPPPQHDKEIDQDFANMVQAVQYGKETPQQGAEQFMQEANDLLQNGGE

SEQ ID NO: 300 - protein, 448 aa, Artificial
  Substituion in SEQ ID NO 290
MKRGGIRMRKKRWTWTASAAAALVLAGCGTAAAQGGSSGSQAGQAAGSADSKPVVTLTFGFWGDAKEEAVTLAAVKAFEKAYPNIHIQTEFGGPFNQYFTKLSTEVAGGNAPDIMQMDYEYIDAYAKEGQLLNLKGAKGINISTISPSVLKSGYIDGGLYGIPNALNNYAVIYDEAAFAKAGYHGQRVSWQQWADILEKVHKATGKWAENDDESWQTFGYWARQHGQHLYNASGTKLGFTESTLVSYLNYWANLRKEGVVPPGTVTSLIKQTADPTDPMVQGKSDAELTWVNYVVSLQSEMTRSLALALPPTQPGGEEGLYIKPSQFWSIYSKTKYPQQAELFVNFLLNNVQAGKALGLVRGIPVSSSVRTQLMASGTSAPEKAEFQLVNEALKVATPIDPPPPQHDKEIDQDFANMVQAVQYGKETPQNGAEQFMQEANDLLQNGGE

SEQ ID NO: 301 - protein, 448 aa, Artificial
  Substituion in SEQ ID NO 290
MKRGGIRMRKKRWTWTASAAAALVLAGCGTAAAQGGSSGSQAGQAAGSADSKPVVTLTFGFWGDAKEEAVTLAAVKAFEKAYPNIHIQTEFGGPFNQYFTKLSTEVAGGNAPDIMQMDYEYIDAYAKEGQLLNLKGAKGINISTISPSVLKSGYIDGGLYGIPNALNNYAVIYDEAAFAKAGYHGQRVSWQQWADILEKVHKATGKWAENDDESWQTFGYWARQHGQHLYNASGTKIGFTESTLVSYLNYWANLRKEGVVPPGTVTSLIKQTADPTDPMVQGKSDAELTWVNYVVSLQSEMTRSLALALPPTQPGGEEGLYIKPSQFWSIYSKTKYPQQAELFVNFLLNNVQAGKALGLVRGIPVSSSVRTQLMASGTSAPEKAEFQLVNEALKVATPIDPPPPQHDKEIDQDFANMVQAVQYGKETPQQGAEQFMQEANDLLQNGGE

SEQ ID NO: 302 - DNA, 1347 bp, Artificial
  Substituion in SEQ ID NO 291
gtgaaacgaggaggaatccgcatgcgaaaaaagagatggacatggacggcgagcgccgcggctgcgctggtgttggcgggctgcggcaccgcggcggcgcagggcggttcgagtgggtcgcaagccgggcaggccgcgggaagcgcggactcgaagccggtggtcacgctcaccttcggcttctggggcgatgcgaaggaagaggcggtcacgctggccgcggtgaaagcgtttgagaaggcgtatccgaacattcacatccagaccgaattcggagggccattcaatcagtacttcacgaagctgtccaccgaggtcgcgggcggcaacgcaccagacatcatgcagatggattacgaatacattgacgcctacgccaaggaaggccagttgctcaacctgaagggcgcgaagggaatcaacatctccaccatcagcccgagcgtcctgaagagcggctacatcgacggcgggttgtatggcattccgaatgcgctgaataactatgcggtcatctacgacgaggccgcgtttgccaaggcgggctatcacggccaacgcgtttcatggcaacagtgggcggatatcctcgaaaaggtccataaggcgacaggcaagtgggccgagaacgacgacgagagctggcagacctttggatactgggcgcgccagcacggtcagcacctatacaacgcctccgggacgaagctcggatttaccgagagcacgctcgtctcctatctgaactactgggcgaatcttcgcaaagagggcgttgtgccgcccgggaccgtgacatccctcatcaagcagacggccgatccgacggatccgatggtgcaagggaaatcggaagcggaactcacctgggtcaactacgtcgtcagcctgcagagcgagatgacgcgaagcttggcgctggcccttccgccgacacagccgggtggagaggagggcctgtatatcaagccgagccagttctggagcatctattccaagacgaagtatccgcagcaagccgagctctttgtcaacttcttgctgaacaacgtccaagcgggcaaggcgctcgggctcgtgcgcggcatcccggtgtcgtcctccgtccgcactcagttgatggcatccggcacctcggcgcctgaaaaggccgagttccagctggtgaacgaggcgctcaaggtggccacgcccatcgatcctccgccgccgcagcacgacaaggagatcgaccaggacttcgcgaacatggtccaggctgtgcaatacggcaaggaaacgccccagcagggcgccgaacagtttatgcaggaggcgaacgatctcctgcagaacggcggcgagtga

SEQ ID NO: 303 - DNA, 1347 bp, Artificial
  Substituion in SEQ ID NO 291
gtgaaacgaggaggaatccgcatgcgaaaaaagagatggacatggacggcgagcgccgcggctgcgctggtgttggcgggctgcggcaccgcggcggcgcagggcggttcgagtgggtcgcaagccgggcaggccgcgggaagcgcggactcgaagccggtggtcacgctcaccttcggcttctggggcgatgcgaaggaagaggcggtcacgctggccgcggtgaaagcgtttgagaaggcgtatccgaacattcacatccagaccgaattcggagggccattcaatcagtacttcacgaagctgtccaccgaggtcgcgggcggcaacgcaccagacatcatgcagatggattacgaatacattgacgcctacgccaaggaaggccagttgctcaacctgaagggcgcgaagggaatcaacatctccaccatcagcccgagcgtcctgaagagcggctacatcgacggcgggttgtatggcattccgaatgcgctgaataactatgcggtcatctacgacgaggccgcgtttgccaaggcgggctatcacggccaacgcgtttcatggcaacagtgggcggatatcctcgaaaaggtccataaggcgacaggcaagtgggccgagaacgaagacgagagctggcagacctttggatactgggcgcgccagcacggtcagcacctatacaacgcctccgggacgaagctcggatttaccgagagcacgctcgtctcctatctgaactactgggcgaatcttcgcaaagagggcgttgtgccgcccgggaccgtgacatccctcatcaagcagacggccgatccgacggatccgatggtgcaagggaaatcggatgcggaactcacctgggtcaactacgtcgtcagcctgcagagcgagatgacgcgaagcttggcgctggcccttccgccgacacagccgggtggagaggagggcctgtatatcaagccgagccagttctggagcatctattccaagacgaagtatccgcagcaagccgagctctttgtcaacttcttgctgaacaacgtccaagcgggcaaggcgctcgggctcgtgcgcggcatcccggtgtcgtcctccgtccgcactcagttgatggcatccggcacctcggcgcctgaaaaggccgagttccagctggtgaacgaggcgctcaaggtggccacgcccatcgatcctccgccgccgcagcacgacaaggagatcgaccaggacttcgcgaacatggtccaggctgtgcaatacggcaaggaaacgccccagcagggcgccgaacagtttatgcaggaggcgaacgatctcctgcagaacggcggcgagtga

SEQ ID NO: 304 - DNA, 1347 bp, Artificial
  Substituion in SEQ ID NO 291
gtgaaacgaggaggaatccgcatgcgaaaaaagagatggacatggacggcgagcgccgcggctgcgctggtgttggcgggctgcggcaccgcggcggcgcagggcggttcgagtgggtcgcaagccgggcaggccgcgggaagcgcggactcgaagccggtggtcacgctcaccttcggcttctggggcgatgcgaaggaagaggcggtcacgctggccgcggtgaaagcgtttgagaaggcgtatccgaacattcacatccagaccgaattcggagggccattcaatcagtacttcacgaagctgtccaccgaggtcgcgggcggcaacgcaccagacatcatgcagatggattacgaatacattgacgcctacgccaaggaaggccagttgctcaacctgaagggcgcgaagggaatcaacatctccaccatcagcccgagcgtcctgaagagcggctacatcgacggcgggttgtatggcattccgaatgcgctgaataactatgcggtcttatacgacgaggccgcgtttgccaaggcgggctatcacggccaacgcgtttcatggcaacagtgggcggatatcctcgaaaaggtccataaggcgacaggcaagtgggccgagaacgacgacgagagctggcagacctttggatactgggcgcgccagcacggtcagcacctatacaacgcctccgggacgaagctcggatttaccgagagcacgctcgtctcctatctgaactactgggcgaatcttcgcaaagagggcgttgtgccgcccgggaccgtgacatccctcatcaagcagacggccgatccgacggatccgatggtgcaagggaaatcggatgcggaactcacctgggtcaactacgtcgtcagcctgcagagcgagatgacgcgaagcttggcgctggcccttccgccgacacagccgggtggagaggagggcctgtatatcaagccgagccagttctggagcatctattccaagacgaagtatccgcagcaagccgagctctttgtcaacttcttgctgaacaacgtccaagcgggcaaggcgctcgggctcgtgcgcggcatcccggtgtcgtcctccgtccgcactcagttgatggcatccggcacctcggcgcctgaaaaggccgagttccagctggtgaacgaggcgctcaaggtggccacgcccatcgatcctccgccgccgcagcacgacaaggagatcgaccaggacttcgcgaacatggtccaggctgtgcaatacggcaaggaaacgccccagcagggcgccgaacagtttatgcaggaggcgaacgatctcctgcagaacggcggcgagtga

SEQ ID NO: 305 - DNA, 1347 bp, Artificial
  Substituion in SEQ ID NO 291
gtgaaacgaggaggaatccgcatgcgaaaaaagagatggacatggacggcgagcgccgcggctgcgctggtgttggcgggctgcggcaccgcggcggcgcagggcggttcgagtgggtcgcaagccgggcaggccgcgggaagcgcggactcgaagccggtggtcacgctcaccttcggcttctggggcgatgcgaaggaagaggcggtcacgctggccgcggtgaaagcgtttgagaaggcgtatccgaacattcacatccagaccgaattcggagggccattcaatcagtacttcacgaagctgtccaccgaggtcgcgggcggcaacgcaccagacatcatgcagatggattacgaatacattgacgcctacgccaaggaaggccagttgctcaacctgaagggcgcgaagggaatcaacatctccaccatcagcccgagcgtcctgaagagcggctacatcgacggcgggttgtatggcattccgaatgcgctgaataactatgcggtcatctacgacgaggccgcgtttgccaaggcgggctatcacggccaacgcgtttcatggcaacagtgggcggatatcctcgaaaaggtccataaggcgacaggcaagtgggccgagaacgacgacgagagctggcagacctttggatactgggcgcgccagcacggtcagcacctatacaacgcctccgggacgaagctcggatttaccgagagcacgctcgtctcctatctgaactactgggcgaatcttcgcaaagagggcgttgtgccgcccgggaccgtgacatccctcatcaagcagacggccgatccgacggatccgatggtgcaagggaaatcggatgcggaactcacctgggtcaactacgtcgtcagcctgcagagcgagatgacgcgaagcttggcgctggcccttccgccgacacagccgggtggagaggagggcctgtatatcaagccgagccagttctggagcatctattccaagacgaagtatccgcagcaagccgagctctttgtcaacttcttgctgaacaacgtccaagcgggcaaggcgctcgggctcgtgcgcggcatcccggtgtcgtcctccgtccgcactcagttgatggcatccggcacctcggcgcctgaaaaggccgagttccagctggtgaacgaggcgctcaaggtggccacgcccatcgatcctccgccgccgcagcacgacaaggagatcgaccaggacttcgcgaacatggtccaggctgtgcaatacggcaaggaaacgccccagaatggcgccgaacagtttatgcaggaggcgaacgatctcctgcagaacggcggcgagtga

SEQ ID NO: 306 - DNA, 1347 bp, Artificial
  Substituion in SEQ ID NO 291
gtgaaacgaggaggaatccgcatgcgaaaaaagagatggacatggacggcgagcgccgcggctgcgctggtgttggcgggctgcggcaccgcggcggcgcagggcggttcgagtgggtcgcaagccgggcaggccgcgggaagcgcggactcgaagccggtggtcacgctcaccttcggcttctggggcgatgcgaaggaagaggcggtcacgctggccgcggtgaaagcgtttgagaaggcgtatccgaacattcacatccagaccgaattcggagggccattcaatcagtacttcacgaagctgtccaccgaggtcgcgggcggcaacgcaccagacatcatgcagatggattacgaatacattgacgcctacgccaaggaaggccagttgctcaacctgaagggcgcgaagggaatcaacatctccaccatcagcccgagcgtcctgaagagcggctacatcgacggcgggttgtatggcattccgaatgcgctgaataactatgcggtcatctacgacgaggccgcgtttgccaaggcgggctatcacggccaacgcgtttcatggcaacagtgggcggatatcctcgaaaaggtccataaggcgacaggcaagtgggccgagaacgacgacgagagctggcagacctttggatactgggcgcgccagcacggtcagcacctatacaacgcctccgggacgaagattggatttaccgagagcacgctcgtctcctatctgaactactgggcgaatcttcgcaaagagggcgttgtgccgcccgggaccgtgacatccctcatcaagcagacggccgatccgacggatccgatggtgcaagggaaatcggatgcggaactcacctgggtcaactacgtcgtcagcctgcagagcgagatgacgcgaagcttggcgctggcccttccgccgacacagccgggtggagaggagggcctgtatatcaagccgagccagttctggagcatctattccaagacgaagtatccgcagcaagccgagctctttgtcaacttcttgctgaacaacgtccaagcgggcaaggcgctcgggctcgtgcgcggcatcccggtgtcgtcctccgtccgcactcagttgatggcatccggcacctcggcgcctgaaaaggccgagttccagctggtgaacgaggcgctcaaggtggccacgcccatcgatcctccgccgccgcagcacgacaaggagatcgaccaggacttcgcgaacatggtccaggctgtgcaatacggcaaggaaacgccccagcagggcgccgaacagtttatgcaggaggcgaacgatctcctgcagaacggcggcgagtga

SEQ ID NO: 307 - protein, 299 aa, Alicyclobacillus acidocaldarius
MMKEGSPVPRGASNERVEALVRLLGLEPSEKPRSLSELVADREVHVLLPEGTAPAGGYPTAVLIHGHSPLGYDYFRSANEVYVKGAPVAELLRDAGFAVVLPSLRGFGATMDPVDRALGLEHSCERFARQRLLVGRTLLGDRVRDLMELLDAMEMDGRFDIESLVTAGFSGGGTAALFHAACDSRVRHLILLSALCTARHSLLATRHCLCNYVPGLLNFGDWGDVAALVAPRRLTIVHGERDGVFPFEGARAAFAAVEAAYEAVGMTKRAMFLAQPGGHEPYPEVLWQLMGVGLKRATT

SEQ ID NO: 308 - DNA, 900 bp, Alicyclobacillus acidocaldarius
gtgatgaaggagggaagcccggtgccgcgaggggcgtcgaacgaacgagtggaggccctcgttcggctgctcggcctggagccctcggagaagccgagatccttgagcgaactcgtggcggatcgcgaagtccacgtgctccttccggagggcacggcgcccgcgggcggctatcccaccgccgtgttgatccacggccattcgccgctcggctacgattactttcgcagcgcgaacgaggtgtacgtcaagggcgcacccgtggcggagcttttgcgcgacgcgggctttgcggtggtgctcccgtctttgcgcgggtttggcgccacgatggacccggtcgatcgcgccctgggcctggagcacagctgtgagcggttcgcgcggcagcgactgctcgtcggccggacgctcctcggcgatcgcgtccgcgatctgatggaactcctggatgcgatggagatggacggccgcttcgacatagagagccttgtcacggcgggattttcaggcggcggcacggccgcgctgtttcacgcggcctgcgattcgcgggtccgccacctgatcctgctgtcggcgttgtgcaccgcccggcattcgctccttgctacgcggcactgcctgtgcaactacgtaccgggtcttctgaacttcggcgattggggggatgtggcggcgctcgtggcgccgcggcgcctgaccattgtgcatggcgaacgcgacggcgtgtttccgttcgagggtgcgcgtgcagcgtttgcagcggtcgaagcggcgtacgaggccgtgggtatgacaaagcgtgcgatgtttcttgcacaacctgggggtcatgagccgtatccggaggttttgtggcagttgatgggtgtcggtctcaagcgtgcgacaacgtga

SEQ ID NO: 309 - protein, 191 aa, Oceanobacillus iheyensis HTE831
PTVLALHGHGYGMKEAIGLNINGEQCKFTGIHNKFAARLVNKGVIVVVPGIIGFGDRRLDEDMNAEQPLENSCFEIGSQLLLMGKTLAGLRVQEIKRVLDYIQSFNMVDEEKIGSFGFSGGGLVAAFTSILDERIKATVLSGYLSTFKGSIMSRRHCLDNYIPGILEIGEMDELIALIAPRPLFIESGKDD

SEQ ID NO: 310 - protein, 260 aa, Victivallis vadensis ATCC BAA-548
EKLRFSPEEGEEACIYICLPELPPPYKTFICLQGHSTGMHNSIAVEWQDETVPKAIEGDRDFAIGCLKRGIAAVCLEQRYMGERSSDPEHHPACLLPTLQNLMIGRTAIGDRVYDVDRLIDYLYTRGDIDRTRLGVMGNSGGGTTGMFAGAVLDRITHVIASCSFSSFRGSIGSMFHCACNYVPGLLEYGESADVVGLTAPKPVVIVNGDADEIFPLDEADRQFRRLEAVYRAAGAAGNCVHAVGGGGHRFYAAEAWSAM

SEQ ID NO: 311 - protein, 182 aa, Bacillus clausii KSM-K16
PVGGNREAVVLALHGHGAGAEEALQEDSSHNAFALKLVEQGAVVVLPELAGFGARKRKQDQAEKNSCFSIASHLLLYGKTLAGLRVFECARLLDWVGETRRGNVGCIGFSGGALIALLLAATDERIKATVLSGFASLMRDSILASRHCLDNYIPGLLAIGETPQLLELINPRALFVESGNDD

SEQ ID NO: 312 - protein, 192 aa, Planctomyces maris DSM 8797
PAIVCMHGHSGIIPYIDEGKTKADKEKTRQSELDYAVYFAKHGYITAAIVMRGWNETAGDQDRGVSHTKRSCLQMTMNALLIGSTPQGQRSWDAMRVIDFLQTQDQVDPDRIAAAGLSGGGATAMYLPILDERVKLTMIAGAFSTYRASYYSMPHCLCQCMPEMMRFGEMSDVVALHAPRPVLLINGIDDKI

SEQ ID NO: 313 - protein, 193 aa, Blastopirellula marina DSM 3645
PAIICLHGHSGIDPYIRLNEDEKQKKKTDESALDYAVYMAEHGYVTAAMVVRGWNETCGRRDAGYKSTHLRSCHEMSMNAFLMGMTPQGIRCWDAMRVVDFLQSREEVDPDKIGVGGLSGGGTLTMYLPILDERIKLAMIAGAFSEYRTSIFSIHHCICNCLPGVMRHGEMADVVALFAPRPVLLINGIDDPI

SEQ ID NO: 314 - protein, 299 aa, Artificial
  Substituion in SEQ ID NO 307
MMKEGSPVPRGASNERVEALVRLLGLEPSEKPRSLSELVADREVHVLLPEGTAPAGGYPTAVLIHGHSPLGYDYFRSANEVYVKGAPVAELLRDAGFAVVLPSLRGFGATMDPVDRALGLEHSCERFARQRLLVGRTLLGDRVRDLMELLDAMEMDGRFDIESLVTAGFSGGGTAALFHAACDSRVRHLLLLSALCTARHSLLATRHCLCNYVPGLLNFGDWGDVAALVAPRRLTIVHGERDGVFPFEGARAAFAAVEAAYEAVGMTKRAMFLAQPGGHEPYPEVLWQLMGVGLKRATT

SEQ ID NO: 315 - protein, 299 aa, Artificial
  Substituion in SEQ ID NO 307
MMKEGSPVPRGASNERVEALVRLLGLEPSEKPRSLSELVADREVHVLLPEGTAPAGGYPTAVLLHGHSPLGYDYFRSANEVYVKGAPVAELLRDAGFAVVLPSLRGFGATMDPVDRALGLEHSCERFARQRLLVGRTLLGDRVRDLMELLDAMEMDGRFDIESLVTAGFSGGGTAALFHAACDSRVRHLILLSALCTARHSLLATRHCLCNYVPGLLNFGDWGDVAALVAPRRLTIVHGERDGVFPFEGARAAFAAVEAAYEAVGMTKRAMFLAQPGGHEPYPEVLWQLMGVGLKRATT

SEQ ID NO: 316 - protein, 299 aa, Artificial
  Substituion in SEQ ID NO 307
MMKEGSPVPRGASNERVEALVRLLGLEPSEKPRSLSELVADREVHVLLPEGTAPAGGYPTAVLIHGHSPLGYDYFRSANEVYVKGAPVAELLRDAGFAVVLPSLRGFGATMDPVDRALGLEHSCERFARQRLLVGRTLLGDRVRDLMELLDAMEMDGRFDIESLVTAGFSGGGTAALFHAACDSRVRHLILLSALCTARHSLLATRHCLCNYVPGLLNFGDWGDVAALVAPRRLTIVHGERDGVFPFEGARAAFAAVEAAYEAVGMTKRAMFLAQPGGHEPYPEVLWQLMGVGLKKATT

SEQ ID NO: 317 - protein, 299 aa, Artificial
  Substituion in SEQ ID NO 307
MMKEGSPVPRGASNERVEALVRLLGLEPSEKPKSLSELVADREVHVLLPEGTAPAGGYPTAVLIHGHSPLGYDYFRSANEVYVKGAPVAELLRDAGFAVVLPSLRGFGATMDPVDRALGLEHSCERFARQRLLVGRTLLGDRVRDLMELLDAMEMDGRFDIESLVTAGFSGGGTAALFHAACDSRVRHLILLSALCTARHSLLATRHCLCNYVPGLLNFGDWGDVAALVAPRRLTIVHGERDGVFPFEGARAAFAAVEAAYEAVGMTKRAMFLAQPGGHEPYPEVLWQLMGVGLKRATT

SEQ ID NO: 318 - protein, 299 aa, Artificial
  Substituion in SEQ ID NO 307
MMKEGSPVPRGASNERVEALVRLLGLEPSEKPRSLSELVADREVHVLLPEGTAPAGGYPTAVLIHGHSPLGYDYFRSANEVYVKGAPVAELLRDAGFAVVLPSLRGFGATMDPVDRALGLEHSCERFARQRLLVGRTLLGDRVRDLMELLDAMEMDGRFDIESLVTAGFSGGGTAALFHAACDSRVRHLILLSALCTARHSLLATRHCLCNYVPGLLNFGDWGDVAALVAPRRLTIVHGERDGVFPFEGARAAFAAVEAAYEAVGMTRRAMFLAQPGGHEPYPEVLWQLMGVGLKRATT

SEQ ID NO: 319 - DNA, 900 bp, Artificial
  Substituion in SEQ ID NO 308
gtgatgaaggagggaagcccggtgccgcgaggggcgtcgaacgaacgagtggaggccctcgttcggctgctcggcctggagccctcggagaagccgagatccttgagcgaactcgtggcggatcgcgaagtccacgtgctccttccggagggcacggcgcccgcgggcggctatcccaccgccgtgttgatccacggccattcgccgctcggctacgattactttcgcagcgcgaacgaggtgtacgtcaagggcgcacccgtggcggagcttttgcgcgacgcgggctttgcggtggtgctcccgtctttgcgcgggtttggcgccacgatggacccggtcgatcgcgccctgggcctggagcacagctgtgagcggttcgcgcggcagcgactgctcgtcggccggacgctcctcggcgatcgcgtccgcgatctgatggaactcctggatgcgatggagatggacggccgcttcgacatagagagccttgtcacggcgggattttcaggcggcggcacggccgcgctgtttcacgcggcctgcgattcgcgggtccgccacctgttactgctgtcggcgttgtgcaccgcccggcattcgctccttgctacgcggcactgcctgtgcaactacgtaccgggtcttctgaacttcggcgattggggggatgtggcggcgctcgtggcgccgcggcgcctgaccattgtgcatggcgaacgcgacggcgtgtttccgttcgagggtgcgcgtgcagcgtttgcagcggtcgaagcggcgtacgaggccgtgggtatgacaaagcgtgcgatgtttcttgcacaacctgggggtcatgagccgtatccggaggttttgtggcagttgatgggtgtcggtctcaagcgtgcgacaacgtga

SEQ ID NO: 320 - DNA, 900 bp, Artificial
  Substituion in SEQ ID NO 308
gtgatgaaggagggaagcccggtgccgcgaggggcgtcgaacgaacgagtggaggccctcgttcggctgctcggcctggagccctcggagaagccgagatccttgagcgaactcgtggcggatcgcgaagtccacgtgctccttccggagggcacggcgcccgcgggcggctatcccaccgccgtgttgttacacggccattcgccgctcggctacgattactttcgcagcgcgaacgaggtgtacgtcaagggcgcacccgtggcggagcttttgcgcgacgcgggctttgcggtggtgctcccgtctttgcgcgggtttggcgccacgatggacccggtcgatcgcgccctgggcctggagcacagctgtgagcggttcgcgcggcagcgactgctcgtcggccggacgctcctcggcgatcgcgtccgcgatctgatggaactcctggatgcgatggagatggacggccgcttcgacatagagagccttgtcacggcgggattttcaggcggcggcacggccgcgctgtttcacgcggcctgcgattcgcgggtccgccacctgatcctgctgtcggcgttgtgcaccgcccggcattcgctccttgctacgcggcactgcctgtgcaactacgtaccgggtcttctgaacttcggcgattggggggatgtggcggcgctcgtggcgccgcggcgcctgaccattgtgcatggcgaacgcgacggcgtgtttccgttcgagggtgcgcgtgcagcgtttgcagcggtcgaagcggcgtacgaggccgtgggtatgacaaagcgtgcgatgtttcttgcacaacctgggggtcatgagccgtatccggaggttttgtggcagttgatgggtgtcggtctcaagcgtgcgacaacgtga

SEQ ID NO: 321 - DNA, 900 bp, Artificial
  Substituion in SEQ ID NO 308
gtgatgaaggagggaagcccggtgccgcgaggggcgtcgaacgaacgagtggaggccctcgttcggctgctcggcctggagccctcggagaagccgagatccttgagcgaactcgtggcggatcgcgaagtccacgtgctccttccggagggcacggcgcccgcgggcggctatcccaccgccgtgttgatccacggccattcgccgctcggctacgattactttcgcagcgcgaacgaggtgtacgtcaagggcgcacccgtggcggagcttttgcgcgacgcgggctttgcggtggtgctcccgtctttgcgcgggtttggcgccacgatggacccggtcgatcgcgccctgggcctggagcacagctgtgagcggttcgcgcggcagcgactgctcgtcggccggacgctcctcggcgatcgcgtccgcgatctgatggaactcctggatgcgatggagatggacggccgcttcgacatagagagccttgtcacggcgggattttcaggcggcggcacggccgcgctgtttcacgcggcctgcgattcgcgggtccgccacctgatcctgctgtcggcgttgtgcaccgcccggcattcgctccttgctacgcggcactgcctgtgcaactacgtaccgggtcttctgaacttcggcgattggggggatgtggcggcgctcgtggcgccgcggcgcctgaccattgtgcatggcgaacgcgacggcgtgtttccgttcgagggtgcgcgtgcagcgtttgcagcggtcgaagcggcgtacgaggccgtgggtatgacaaagcgtgcgatgtttcttgcacaacctgggggtcatgagccgtatccggaggttttgtggcagttgatgggtgtcggtctcaagaaagcgacaacgtga

SEQ ID NO: 322 - DNA, 900 bp, Artificial
  Substituion in SEQ ID NO 308
gtgatgaaggagggaagcccggtgccgcgaggggcgtcgaacgaacgagtggaggccctcgttcggctgctcggcctggagccctcggagaagccgaaatccttgagcgaactcgtggcggatcgcgaagtccacgtgctccttccggagggcacggcgcccgcgggcggctatcccaccgccgtgttgatccacggccattcgccgctcggctacgattactttcgcagcgcgaacgaggtgtacgtcaagggcgcacccgtggcggagcttttgcgcgacgcgggctttgcggtggtgctcccgtctttgcgcgggtttggcgccacgatggacccggtcgatcgcgccctgggcctggagcacagctgtgagcggttcgcgcggcagcgactgctcgtcggccggacgctcctcggcgatcgcgtccgcgatctgatggaactcctggatgcgatggagatggacggccgcttcgacatagagagccttgtcacggcgggattttcaggcggcggcacggccgcgctgtttcacgcggcctgcgattcgcgggtccgccacctgatcctgctgtcggcgttgtgcaccgcccggcattcgctccttgctacgcggcactgcctgtgcaactacgtaccgggtcttctgaacttcggcgattggggggatgtggcggcgctcgtggcgccgcggcgcctgaccattgtgcatggcgaacgcgacggcgtgtttccgttcgagggtgcgcgtgcagcgtttgcagcggtcgaagcggcgtacgaggccgtgggtatgacaaagcgtgcgatgtttcttgcacaacctgggggtcatgagccgtatccggaggttttgtggcagttgatgggtgtcggtctcaagcgtgcgacaacgtga

SEQ ID NO: 323 - DNA, 900 bp, Artificial
  Substituion in SEQ ID NO 308
gtgatgaaggagggaagcccggtgccgcgaggggcgtcgaacgaacgagtggaggccctcgttcggctgctcggcctggagccctcggagaagccgagatccttgagcgaactcgtggcggatcgcgaagtccacgtgctccttccggagggcacggcgcccgcgggcggctatcccaccgccgtgttgatccacggccattcgccgctcggctacgattactttcgcagcgcgaacgaggtgtacgtcaagggcgcacccgtggcggagcttttgcgcgacgcgggctttgcggtggtgctcccgtctttgcgcgggtttggcgccacgatggacccggtcgatcgcgccctgggcctggagcacagctgtgagcggttcgcgcggcagcgactgctcgtcggccggacgctcctcggcgatcgcgtccgcgatctgatggaactcctggatgcgatggagatggacggccgcttcgacatagagagccttgtcacggcgggattttcaggcggcggcacggccgcgctgtttcacgcggcctgcgattcgcgggtccgccacctgatcctgctgtcggcgttgtgcaccgcccggcattcgctccttgctacgcggcactgcctgtgcaactacgtaccgggtcttctgaacttcggcgattggggggatgtggcggcgctcgtggcgccgcggcgcctgaccattgtgcatggcgaacgcgacggcgtgtttccgttcgagggtgcgcgtgcagcgtttgcagcggtcgaagcggcgtacgaggccgtgggtatgacacgtcgtgcgatgtttcttgcacaacctgggggtcatgagccgtatccggaggttttgtggcagttgatgggtgtcggtctcaagcgtgcgacaacgtga

SEQ ID NO: 324 - protein, 442 aa, Alicyclobacillus acidocaldarius
MATRFRWVIIGLLFFITVVNYIDRSAISYAIGDIAQVLHLNDSQVGMILGAFGIGYMITTFFGGIWVDHVGARWALFFASLLWSLSIGLTGVAASFTVIYLMRILLGVAEGPNFPAVNRAVGDWLSPRERAIALSNSLVAVPLALAIGAPIVTSLILGVGWRGMFIILGIVGLLWVPVWFFLFRDFPEHSRHVNDEELRHIRASEHVDRTRPAKEMRFRQAHHVSSGTLWKYLLVNRTLMANNWSFFVFGYYLFFFMTWLPSYLKSEYHLNLKSVGAFSILPWALATVLLWLVGYLSDWILRRTGSLRLARSYPIWISQLLSALCVVPLTFTHDLTTAIVFITLAVGFGMSANSTFYAMNVDLMRERTGTALGLMDTFFAAAGFLAPVITGWIVNATGSFKSAFWLMAVLSATSVLAVLIFHQPDKQRRIESAVAPSSNLTH

SEQ ID NO: 325 - DNA, 1329 bp, Alicyclobacillus acidocaldarius
atggccacgcgctttcgctgggtcatcattggtcttttgtttttcatcacggtggtcaactacatcgaccgatccgccatctcgtacgccatcggcgacatcgcgcaggttctgcacctgaacgacagccaggtgggcatgatcctcggcgcctttggcatcggttacatgatcaccacgtttttcggcggcatctgggtcgatcacgtcggcgcccgatgggccctgttctttgcgtcgctcttgtggagcctgtccatcggactgacgggcgtcgcagcgtcgttcaccgtcatctacctcatgcgcatccttctcggtgtggcggaagggccgaacttcccagccgtcaaccgggcggtcggcgactggctgtcgcctcgcgagcgagccatcgcgctgtccaactcgctcgtggccgtcccactcgcgctcgccatcggcgccccgattgtgacgtccttgattctcggtgtcggctggcgaggcatgtttatcatcctcggcattgtgggccttctctgggtacccgtctggttcttcttgttccgcgattttccggagcatagccgccacgtgaacgacgaggaactgcgccacatccgcgcatccgaacatgtggatcgcacgcggccggccaaggagatgcgctttcgccaggcgcatcacgtgtcgtccggcacgctgtggaagtacctcttggtcaaccgcaccttaatggcgaacaactggtcgttcttcgtcttcggctattatctcttcttcttcatgacgtggttgccatcctatctgaagagcgaatatcacctgaacctgaagtcggtcggcgccttctccatcttgccgtgggcgcttgccaccgtgctgttgtggctcgtgggttatctctcggactggatcctgcgccgaacaggcagcctgcgcctggcgagatcgtaccccatctggatctcgcaactgctgtcggcgctgtgcgtcgtgccgctcacctttacgcacgacctcacgacggccatcgtgttcatcacgctcgcggtgggctttggcatgagcgccaactcgaccttctacgccatgaacgtggacctcatgcgagagcggacgggcaccgcgctcggcttgatggacacgttcttcgcagccgccggtttccttgcgccggtcatcacgggatggattgtgaacgcgacgggaagcttcaagagcgccttctggctcatggccgtgctctcggcgacgtccgtcctcgccgtcctcatcttccatcagccggacaaacagcgccgaatcgaaagcgcagtggccccctcttcaaacctcacgcactga

SEQ ID NO: 326 - protein, 417 aa, Azorhizobium caulinodans ORS 571
TRYRWFVIFLLFAITVVNYIDRAAIAYAITAMERDLGLSPAAAGSILGAFGVGYAITTLLGGFAVDRYGARLVLTISAVLWSLSIGGTAMATGFASLYAARVLLGVSEGPNFPALTGAVSRWLAPNERATALGNALVAVPVALAIGGPIVTQLLAHLDWRTAFGVLFALSIMWVPLWLVFFRNRPEDSRFVNAAELAHIRTPDATGPAKPAAGHGPGLARLLLTNPTLVSNYWAFFVFGYFLFFFMTWLPSYLEQAYHLNLKQVGLFTVLPWLAAAVALWSMGRWSDHLLRTTGRLRVARSYLIAGSQLVAALAIVPVALTDNLAVAITGITVAVAASMGSNAAYYAVNVDVVPERAASALGIMDFAFALAGFLAPAITGWVLALRGSFTDGFALMAALALSSVVVVLLFHHPDRHR

SEQ ID NO: 327 - protein, 425 aa, Sagittula stellata E-37
SHYRWVVVALLFAIVVINYIDRSAISYAIDPISKELSLTASQKGLILGAFGVGYMFTTFIGGVLTDRFGPRIILTVAVILWAVSSALTAVASSFFLLLALRALLGLAEGPMFPGLTGAVAHWLSPKERAKALGYSLAAVPLALAIGGPIVSGILSLTDWRSLYWILAVGSLVWFPLWFWMFRNRPEDSAHVNEAELAQIRHKDIEVIDTGRGTGEVVPARSDNATATTWKRLFTNPTLLANYWAFFVFGYFLFFFMTWLPGFLEQKFSVSVANVGWFSFVPWAVAGVVLLLLGNLSDGLLEKTQSLRISRSWFIIVTQLIAAVVIVPVAFTSTLWVALALITVALASSMGANAVYYAINVDIAPDRSATALGLMDLFFAVSGFAAPAITGWVVGSSGSFTRAFFILAALAGSSVVLTFLFHRPDR

SEQ ID NO: 328 - protein, 413 aa, Serratia proteamaculans 568
MFKNLRWTIVFLLFMVYMINYLDRVALSITVPMIEKDLMLNAEQFGIIFGSFFFGYAIFNFIGGLAVDKFGPTLVLGIAVGLWSIFCGMTALATGFYSMLILRVLFGMAEGPICASANKMINGWFPKKQAATAMGLLSAGSPLGGAVAGPIVGYLALAFGWRPAFMIICSIGIVWMLVWFFVVADNPAKSKRVSDKELALINQMKEETHSAEEELSNAAHGLGYYLKQPIILVTAFAFFCYNYILFFFLSWFPSYLVQAHNLNIKEMSLTTMIPWIVGFVGLALGGYISDKIFNITGKLLLSRKIVLVTSLLAAAVCVALAGTVSSVVPAVMLMSVSIFFLYITGAIYWAIIQDVVHKSRVGGASGFIHLVGSVSGIIGPVVTGYIVQNTGKFDSAFMLAGGVAALGAVLVLL

SEQ ID NO: 329 - protein, 420 aa, Burkholderia multivorans ATCC 17616
MKTRYRWWVGALLFGAGMLNYLDRAALSVVAPIIKRDLGISDAQMGVLFSSFFVGYCVFCFVGGWAADRFGPRRVFAWAAGVWSLFCGATALAGSFVHLLVVRVAFGIGEGPMGTTTNKAISNWFPRREAGRAVGWTNAGQPLGAAIAAPIVGLVALQFGWRVSFVVIAALGFLWLVAWWRLFRDEPAAHPRVSLEEAREIAADRGVDAVHGTRDVHAADAHAARPLLHYLLSRPVLGVALAFFSFNYVLYFFLSWLPSYLTDYQHLNIKQMSVVGILPWLGATVGFVAGGTVSDRIYRHSGDVLFARKIVIVVGLGVAAACVLLASRVNSLGAAVTLIAIASLFAFMAPQACWSLLQEIVPRERVGAAGGFVHLLANLAGILSPSLTGWLVQYGGGYAGAFVLAGASALAGAAILTVAV

SEQ ID NO: 330 - protein, 432 aa, Bacillus anthracis str. Ames
MKNKFRYYVFTMLTFITIVNYIDRGAIAYAQSFIIKEYGFDPKEWGAILGYFGYGYMIGSLLGGIFSDKKGPKFVWIVAATAWSIFEIATAFAGEIGIAVFGGSALIGFAIFRVLFGLTEGPSFAVSNKTAANWAAPKERAFLTSLGFVGVPLGAVLTAPVAVLLLSFTSWKIMFFILGTIGIVWAIIWYFTFTNMPEDHPRVTKEELAEIRSTEGVLQSAKVEKEIPKEPWYSFFKVPTFVMVTIAYFCFQYINFLILTWTPKYLQDVFHFQLSSLWYLGMIPWLGACITLPLGAKLSDRILRKTGNLRLARTGLPIIALLLTAICFSFIPAMNNYVAVLALMSLGNAFAFLPSSLFWAIIVDTAPAYSGTYSGIMHFIANIATILAPTLTGYLVVSYGYPSMFIVAAILAAIAMGAMLFVKPGQQTKTES

SEQ ID NO: 331 - protein, 442 aa, Artificial
  Substituion in SEQ ID NO 324
MATRFRWVIIGLLFFITVVNYIDRSAISYAIGDIAQVLHLNDSQVGMILGAFGIGYMITTFFGGIWVDHVGARWALFFASLLWSLSIGLTGVAASFTVIYLMRILLGVAEGPNFPAVNRAVGDWLSPRERAIALSNSLVAVPLALAIGAPIVTSLILGVGWRGMFIILGIVGLLWVPVWFFLFRDFPEHSRHVNDEELRHIRASEHVDRTRPAKEMRFRQAHHVSSGTLWKYLLVNRTLMANNWSFFVFGYYLFFFMTWLPSYLKSEYHLNLKSVGAFSILPWALATVLLWLVGYLSDWILRRTGSLRLARSYPIWISQLLSALCVVPLTFTHDLTTAIVFITLAVGFGMSANSTFYAMNVDLMRERTGTALGLMDTFFAAAGFLAPVITGWIVNATGSFKSAFWLMAVLSATSVLAVLIFHQPDKQRRIDSAVAPSSNLTH

SEQ ID NO: 332 - protein, 442 aa, Artificial
  Substituion in SEQ ID NO 324
MATRFRWVIIGLLFFITVVNYIDRSAISYAIGDIAQVLHLNDSQVGMILGAFGIGYMITTFFGGIWVDHVGARWALFFASLLWSLSIGLTGVAASFTVLYLMRILLGVAEGPNFPAVNRAVGDWLSPRERAIALSNSLVAVPLALAIGAPIVTSLILGVGWRGMFIILGIVGLLWVPVWFFLFRDFPEHSRHVNDEELRHIRASEHVDRTRPAKEMRFRQAHHVSSGTLWKYLLVNRTLMANNWSFFVFGYYLFFFMTWLPSYLKSEYHLNLKSVGAFSILPWALATVLLWLVGYLSDWILRRTGSLRLARSYPIWISQLLSALCVVPLTFTHDLTTAIVFITLAVGFGMSANSTFYAMNVDLMRERTGTALGLMDTFFAAAGFLAPVITGWIVNATGSFKSAFWLMAVLSATSVLAVLIFHQPDKQRRIESAVAPSSNLTH

SEQ ID NO: 333 - protein, 442 aa, Artificial
  Substituion in SEQ ID NO 324
MATRFRWVIIGLLFFITVVNYIDRSAISYAIGDIAQVLHLNDSQVGMILGAFGIGYMITTFFGGIWVDHVGARWALFFASLLWSLSIGLTGVAASFTVIYLMRILLGVAEGPNFPAVNRAVGDWLSPRERAIALSNSLVAVPLALAIGAPIVTSLILGVGWRGMFIILGIVGLLWVPVWFFLFRDFPEHSRHVNDEELRHIRASEHVDRTRPAKEMRFRQAHHVSSGTLWKYLLVNRTLMANNWSFFVFGYYLFFFMTWLPSYLKSEYHLNLKSVGAFSILPWALATVLLWLVGYLSDWILRRTGSLRLARSYPIWISQLLSALCVVPLTFTHELTTAIVFITLAVGFGMSANSTFYAMNVDLMRERTGTALGLMDTFFAAAGFLAPVITGWIVNATGSFKSAFWLMAVLSATSVLAVLIFHQPDKQRRIESAVAPSSNLTH

SEQ ID NO: 334 - protein, 442 aa, Artificial
  Substituion in SEQ ID NO 324
MATRFRWVIIGLLFFITVVNYIDRSAISYAIGDIAQVLHLNDSQVGMILGAFGIGYMITTFFGGIWVDHVGARWALFFASLLWSLSIGLTGVAASFTVIYLMRILLGVAEGPNFPAVNRAVGDWLSPRERAIALSNSLVAVPLALAIGAPIVTSLILGVGWRGMFIILGIVGLLWVPVWFFLFRDFPEHSRHVNDEELRHIRASEHVDRTRPAKEMRFRNAHHVSSGTLWKYLLVNRTLMANNWSFFVFGYYLFFFMTWLPSYLKSEYHLNLKSVGAFSILPWALATVLLWLVGYLSDWILRRTGSLRLARSYPIWISQLLSALCVVPLTFTHDLTTAIVFITLAVGFGMSANSTFYAMNVDLMRERTGTALGLMDTFFAAAGFLAPVITGWIVNATGSFKSAFWLMAVLSATSVLAVLIFHQPDKQRRIESAVAPSSNLTH

SEQ ID NO: 335 - protein, 442 aa, Artificial
  Substituion in SEQ ID NO 324
MATRFRWVIIGLLFFITVVNYIDRSAISYAIGDIAQVLHLNDSQVGMILGAFGIGYMITTFFGGIWVDHVGARWALFFASLLWSLSIGLTGVAASFTVIYLMRILLGVAEGPNFPAVNRAVGDWLSPRERAIALSNSLVAVPLALAIGAPIVTSLILGVGWRGMFIILGIVGLLWVPVWFFLFRDFPEHSRHVQDEELRHIRASEHVDRTRPAKEMRFRQAHHVSSGTLWKYLLVNRTLMANNWSFFVFGYYLFFFMTWLPSYLKSEYHLNLKSVGAFSILPWALATVLLWLVGYLSDWILRRTGSLRLARSYPIWISQLLSALCVVPLTFTHDLTTAIVFITLAVGFGMSANSTFYAMNVDLMRERTGTALGLMDTFFAAAGFLAPVITGWIVNATGSFKSAFWLMAVLSATSVLAVLIFHQPDKQRRIESAVAPSSNLTH

SEQ ID NO: 336 - DNA, 1329 bp, Artificial
  Substituion in SEQ ID NO 325
atggccacgcgctttcgctgggtcatcattggtcttttgtttttcatcacggtggtcaactacatcgaccgatccgccatctcgtacgccatcggcgacatcgcgcaggttctgcacctgaacgacagccaggtgggcatgatcctcggcgcctttggcatcggttacatgatcaccacgtttttcggcggcatctgggtcgatcacgtcggcgcccgatgggccctgttctttgcgtcgctcttgtggagcctgtccatcggactgacgggcgtcgcagcgtcgttcaccgtcatctacctcatgcgcatccttctcggtgtggcggaagggccgaacttcccagccgtcaaccgggcggtcggcgactggctgtcgcctcgcgagcgagccatcgcgctgtccaactcgctcgtggccgtcccactcgcgctcgccatcggcgccccgattgtgacgtccttgattctcggtgtcggctggcgaggcatgtttatcatcctcggcattgtgggccttctctgggtacccgtctggttcttcttgttccgcgattttccggagcatagccgccacgtgaacgacgaggaactgcgccacatccgcgcatccgaacatgtggatcgcacgcggccggccaaggagatgcgctttcgccaggcgcatcacgtgtcgtccggcacgctgtggaagtacctcttggtcaaccgcaccttaatggcgaacaactggtcgttcttcgtcttcggctattatctcttcttcttcatgacgtggttgccatcctatctgaagagcgaatatcacctgaacctgaagtcggtcggcgccttctccatcttgccgtgggcgcttgccaccgtgctgttgtggctcgtgggttatctctcggactggatcctgcgccgaacaggcagcctgcgcctggcgagatcgtaccccatctggatctcgcaactgctgtcggcgctgtgcgtcgtgccgctcacctttacgcacgacctcacgacggccatcgtgttcatcacgctcgcggtgggctttggcatgagcgccaactcgaccttctacgccatgaacgtggacctcatgcgagagcggacgggcaccgcgctcggcttgatggacacgttcttcgcagccgccggtttccttgcgccggtcatcacgggatggattgtgaacgcgacgggaagcttcaagagcgccttctggctcatggccgtgctctcggcgacgtccgtcctcgccgtcctcatcttccatcagccggacaaacagcgccgaatcgatagcgcagtggccccctcttcaaacctcacgcactga

SEQ ID NO: 337 - DNA, 1329 bp, Artificial
  Substituion in SEQ ID NO 325
atggccacgcgctttcgctgggtcatcattggtcttttgtttttcatcacggtggtcaactacatcgaccgatccgccatctcgtacgccatcggcgacatcgcgcaggttctgcacctgaacgacagccaggtgggcatgatcctcggcgcctttggcatcggttacatgatcaccacgtttttcggcggcatctgggtcgatcacgtcggcgcccgatgggccctgttctttgcgtcgctcttgtggagcctgtccatcggactgacgggcgtcgcagcgtcgttcaccgtcttatacctcatgcgcatccttctcggtgtggcggaagggccgaacttcccagccgtcaaccgggcggtcggcgactggctgtcgcctcgcgagcgagccatcgcgctgtccaactcgctcgtggccgtcccactcgcgctcgccatcggcgccccgattgtgacgtccttgattctcggtgtcggctggcgaggcatgtttatcatcctcggcattgtgggccttctctgggtacccgtctggttcttcttgttccgcgattttccggagcatagccgccacgtgaacgacgaggaactgcgccacatccgcgcatccgaacatgtggatcgcacgcggccggccaaggagatgcgctttcgccaggcgcatcacgtgtcgtccggcacgctgtggaagtacctcttggtcaaccgcaccttaatggcgaacaactggtcgttcttcgtcttcggctattatctcttcttcttcatgacgtggttgccatcctatctgaagagcgaatatcacctgaacctgaagtcggtcggcgccttctccatcttgccgtgggcgcttgccaccgtgctgttgtggctcgtgggttatctctcggactggatcctgcgccgaacaggcagcctgcgcctggcgagatcgtaccccatctggatctcgcaactgctgtcggcgctgtgcgtcgtgccgctcacctttacgcacgacctcacgacggccatcgtgttcatcacgctcgcggtgggctttggcatgagcgccaactcgaccttctacgccatgaacgtggacctcatgcgagagcggacgggcaccgcgctcggcttgatggacacgttcttcgcagccgccggtttccttgcgccggtcatcacgggatggattgtgaacgcgacgggaagcttcaagagcgccttctggctcatggccgtgctctcggcgacgtccgtcctcgccgtcctcatcttccatcagccggacaaacagcgccgaatcgaaagcgcagtggccccctcttcaaacctcacgcactga

SEQ ID NO: 338 - DNA, 1329 bp, Artificial
  Substituion in SEQ ID NO 325
atggccacgcgctttcgctgggtcatcattggtcttttgtttttcatcacggtggtcaactacatcgaccgatccgccatctcgtacgccatcggcgacatcgcgcaggttctgcacctgaacgacagccaggtgggcatgatcctcggcgcctttggcatcggttacatgatcaccacgtttttcggcggcatctgggtcgatcacgtcggcgcccgatgggccctgttctttgcgtcgctcttgtggagcctgtccatcggactgacgggcgtcgcagcgtcgttcaccgtcatctacctcatgcgcatccttctcggtgtggcggaagggccgaacttcccagccgtcaaccgggcggtcggcgactggctgtcgcctcgcgagcgagccatcgcgctgtccaactcgctcgtggccgtcccactcgcgctcgccatcggcgccccgattgtgacgtccttgattctcggtgtcggctggcgaggcatgtttatcatcctcggcattgtgggccttctctgggtacccgtctggttcttcttgttccgcgattttccggagcatagccgccacgtgaacgacgaggaactgcgccacatccgcgcatccgaacatgtggatcgcacgcggccggccaaggagatgcgctttcgccaggcgcatcacgtgtcgtccggcacgctgtggaagtacctcttggtcaaccgcaccttaatggcgaacaactggtcgttcttcgtcttcggctattatctcttcttcttcatgacgtggttgccatcctatctgaagagcgaatatcacctgaacctgaagtcggtcggcgccttctccatcttgccgtgggcgcttgccaccgtgctgttgtggctcgtgggttatctctcggactggatcctgcgccgaacaggcagcctgcgcctggcgagatcgtaccccatctggatctcgcaactgctgtcggcgctgtgcgtcgtgccgctcacctttacgcacgaactcacgacggccatcgtgttcatcacgctcgcggtgggctttggcatgagcgccaactcgaccttctacgccatgaacgtggacctcatgcgagagcggacgggcaccgcgctcggcttgatggacacgttcttcgcagccgccggtttccttgcgccggtcatcacgggatggattgtgaacgcgacgggaagcttcaagagcgccttctggctcatggccgtgctctcggcgacgtccgtcctcgccgtcctcatcttccatcagccggacaaacagcgccgaatcgaaagcgcagtggccccctcttcaaacctcacgcactga

SEQ ID NO: 339 - DNA, 1329 bp, Artificial
  Substituion in SEQ ID NO 325
atggccacgcgctttcgctgggtcatcattggtcttttgtttttcatcacggtggtcaactacatcgaccgatccgccatctcgtacgccatcggcgacatcgcgcaggttctgcacctgaacgacagccaggtgggcatgatcctcggcgcctttggcatcggttacatgatcaccacgtttttcggcggcatctgggtcgatcacgtcggcgcccgatgggccctgttctttgcgtcgctcttgtggagcctgtccatcggactgacgggcgtcgcagcgtcgttcaccgtcatctacctcatgcgcatccttctcggtgtggcggaagggccgaacttcccagccgtcaaccgggcggtcggcgactggctgtcgcctcgcgagcgagccatcgcgctgtccaactcgctcgtggccgtcccactcgcgctcgccatcggcgccccgattgtgacgtccttgattctcggtgtcggctggcgaggcatgtttatcatcctcggcattgtgggccttctctgggtacccgtctggttcttcttgttccgcgattttccggagcatagccgccacgtgaacgacgaggaactgcgccacatccgcgcatccgaacatgtggatcgcacgcggccggccaaggagatgcgctttcgcaatgcgcatcacgtgtcgtccggcacgctgtggaagtacctcttggtcaaccgcaccttaatggcgaacaactggtcgttcttcgtcttcggctattatctcttcttcttcatgacgtggttgccatcctatctgaagagcgaatatcacctgaacctgaagtcggtcggcgccttctccatcttgccgtgggcgcttgccaccgtgctgttgtggctcgtgggttatctctcggactggatcctgcgccgaacaggcagcctgcgcctggcgagatcgtaccccatctggatctcgcaactgctgtcggcgctgtgcgtcgtgccgctcacctttacgcacgacctcacgacggccatcgtgttcatcacgctcgcggtgggctttggcatgagcgccaactcgaccttctacgccatgaacgtggacctcatgcgagagcggacgggcaccgcgctcggcttgatggacacgttcttcgcagccgccggtttccttgcgccggtcatcacgggatggattgtgaacgcgacgggaagcttcaagagcgccttctggctcatggccgtgctctcggcgacgtccgtcctcgccgtcctcatcttccatcagccggacaaacagcgccgaatcgaaagcgcagtggccccctcttcaaacctcacgcactga

SEQ ID NO: 340 - DNA, 1329 bp, Artificial
  Substituion in SEQ ID NO 325
atggccacgcgctttcgctgggtcatcattggtcttttgtttttcatcacggtggtcaactacatcgaccgatccgccatctcgtacgccatcggcgacatcgcgcaggttctgcacctgaacgacagccaggtgggcatgatcctcggcgcctttggcatcggttacatgatcaccacgtttttcggcggcatctgggtcgatcacgtcggcgcccgatgggccctgttctttgcgtcgctcttgtggagcctgtccatcggactgacgggcgtcgcagcgtcgttcaccgtcatctacctcatgcgcatccttctcggtgtggcggaagggccgaacttcccagccgtcaaccgggcggtcggcgactggctgtcgcctcgcgagcgagccatcgcgctgtccaactcgctcgtggccgtcccactcgcgctcgccatcggcgccccgattgtgacgtccttgattctcggtgtcggctggcgaggcatgtttatcatcctcggcattgtgggccttctctgggtacccgtctggttcttcttgttccgcgattttccggagcatagccgccacgtgcaagacgaggaactgcgccacatccgcgcatccgaacatgtggatcgcacgcggccggccaaggagatgcgctttcgccaggcgcatcacgtgtcgtccggcacgctgtggaagtacctcttggtcaaccgcaccttaatggcgaacaactggtcgttcttcgtcttcggctattatctcttcttcttcatgacgtggttgccatcctatctgaagagcgaatatcacctgaacctgaagtcggtcggcgccttctccatcttgccgtgggcgcttgccaccgtgctgttgtggctcgtgggttatctctcggactggatcctgcgccgaacaggcagcctgcgcctggcgagatcgtaccccatctggatctcgcaactgctgtcggcgctgtgcgtcgtgccgctcacctttacgcacgacctcacgacggccatcgtgttcatcacgctcgcggtgggctttggcatgagcgccaactcgaccttctacgccatgaacgtggacctcatgcgagagcggacgggcaccgcgctcggcttgatggacacgttcttcgcagccgccggtttccttgcgccggtcatcacgggatggattgtgaacgcgacgggaagcttcaagagcgccttctggctcatggccgtgctctcggcgacgtccgtcctcgccgtcctcatcttccatcagccggacaaacagcgccgaatcgaaagcgcagtggccccctcttcaaacctcacgcactga

SEQ ID NO: 341 - protein, 309 aa, Alicyclobacillus acidocaldarius
MTWFRRYRLGPLLGLVLLILILAVASRQFFTASNLLDIALQTSVNALLAIGMTFVILTAGIDLSVGSTLALTSAIAAQWMVGGTSPWLAGISALCIGAIAGAFNGVLVAYARLAPFIVTLGTMTLFRGLTEIYTNGQPIFNLPYSFNGLGNGAVLGVPVPVWITMIVFLIAWMVLSRTVAGRRIYAIGGNEKVAYLAGVRAKRYLVAVYVVSGILAALAGLILTSRLATAEPTAGQGYELDAITAVVLGGTSLFGGEGTLVGTIIGALILGVIDNGLNLLNVSSFYQDAVKGLVILIAIMLDRKRSEGR

SEQ ID NO: 342 - DNA, 930 bp, Alicyclobacillus acidocaldarius
atgacttggtttcgcaggtatcggttgggccctcttctcgggttggttttgctcattctcatcctggctgtagcatctcggcagttcttcactgcgagtaacctgttggacattgcgttgcaaacatccgtgaatgcgctcttggccatcgggatgacgtttgtgatcctaacggccggaattgacctgtcggtaggatccacgctggcactgacatcggccatcgcggcacagtggatggtgggcggtacaagtccatggctggcaggcatatctgcgttatgcattggagccatcgccggagcgttcaatggtgtcctcgtggcctatgcacgtcttgcgcccttcatcgtcacacttggaacgatgacgttgtttcgtggtttaaccgaaatttatacgaacggtcaacccatttttaacctgccttattcctttaacgggctcgggaacggggcggttctaggagttcctgtccccgtctggatcacgatgatcgtgttccttatcgcatggatggttctctcgcgcactgtggcaggcagaaggatttatgccattggaggaaacgagaaagttgcgtacttggcgggggttcgcgccaagcgatatctggtggcggtctatgtggtcagtggtattttagcggcactggctggcctcattctcacttctcgtcttgcaactgccgaaccgaccgcagggcaaggttacgagctcgatgcaatcacggccgtcgtactcggtggaactagtcttttcggcggtgaggggactttagtcgggaccatcatcggcgcgctgattctcggtgtcattgacaacggtctgaacttgttaaatgtaagttccttctatcaagatgctgtcaagggcctcgttattctgatcgccatcatgttggaccgtaagagatccgaagggagataa

SEQ ID NO: 343 - protein, 284 aa, Desulfotomaculum reducens MI-1
SDRFFTTSNLLNVARQVSINTLLGVGMTFVILTGGIDLSVGSILALAGALGAGFLGQGNTTLMVVLYACLIGLLAGTVNGTIVAYGRVAPFIATLATMTLFRGATLIYTEGRPVRAVAEGFNELGGGYLGAIPTPVIITSVIVLLAWFVLTQMTPGRRIFALGGNEEAAILSGIRTNHYKIMVYSISGLLAGLAGVILSSRLLSAQPTAGIGYELDAIAAVVIGGTSLTGGQGGVIGTLIGALIIGVIDNGLNLLNVSSFYQQAVKGLIILVAVLLDRRNAVGR

SEQ ID NO: 344 - protein, 280 aa, Bacillus selenitireducens MLS10
FLSPNNLMNVLRQVSINALIAFGMTFVILTGGIDLSVGSILALSGAVTATLMASGVDPVLSVLIGLLAGAALGAFNGIIIAKGKVAPFIATLATMTIFRGLTLVFTDGRPVSGLGDSTFFDMLGRGYLFGIPVPAVTMMVSFLVLYLILKKTTFGRRVYAVGGNEEAAVLSGINADRVKIYVYSLTGFLAALAGTILTSRLSSAQPTAGQMYELDAIAAVVLGGTSLTGGRGWIVGTLIGALIIGVLNNGLNLLGVSSFFQQVVKGSVILLAVLLDRKKN

SEQ ID NO: 345 - protein, 280 aa, Bacillus pumilus SAFR-032
FLEPLNILNLLRQISINALIAFGMTFVILTGGIDLSVGAILALSSALTAGFIVSGMDPILAIIVGSIIGAILGMVNGLLITKGKMAPFIATLATMTIFRGLTLVYTDGNPITGLGSNYAFQLFGRGYFLGIPVPAITMLLTFIVLWVLLHKTPFGRRTYAIGGNEKAALISGIKVPRVKIMIYSLAGFMSALAGAILTSRLNSAQPTAGTSYELDAIAAVVLGGTSLSGGRGRIVGTLIGVLIIGVLNNGMNLLGVSSFYQSVVKGIVILIAVLLDRKKS

SEQ ID NO: 346 - protein, 279 aa, Clostridium novyi NT
SPRFLTVPNIKNVLTQVSVNAIIAIGMTFVILTGGIDLSVGSTLAISGAVAATLIKANCSIFVAIIVAIIVGIIVGLVNGVVIAKGKIQAFIATLATMTVFRGVTQVYTNGTPVSKLGEAFGKIGNTEIIGIPLPVVITIAVFLVAFYVLNETRCGRYIYALGGNEDSARLSGINTTKMKMLVYVISGVTAAISGVVVTSRIGSASAIAGTGYELDAIAAVVLGGTSLAGGEGSIAGTIIGALIIGVLNNGLNLLNVSPYYQLIVKGLVILLAVMVDRK

SEQ ID NO: 347 - protein, 280 aa, Oceanobacillus iheyensis HTE831
FLDPANIMNLLRQISINGLIAFGMTFVILTGGIDLSVGSILALSSALAAIMMTSGIDPILAVIIGVLLGAVFGALNGILVSKGNLAPFIVTLATMTIFRGLTLVFTDGKPITGLGDSYAFQLFGKGYFLGIPVPAVTMIIAFVILWFLLHKMSFGRKTYAIGGNEKAAKISGIKVDRVKIFIYSISGMMAALAGMILTSRLNSAQPTAGTSYEMDAIAAVVLGGTSLAGGKGRIAGTFIGVLIIGILNNGMNLLGISSFYQQVVKGVVILIAVLLDRKKS

SEQ ID NO: 348 - protein, 309 aa, Artificial
  Substituion in SEQ ID NO 341
MTWFRRYRLGPILGLVLLILILAVASRQFFTASNLLDIALQTSVNALLAIGMTFVILTAGIDLSVGSTLALTSAIAAQWMVGGTSPWLAGISALCIGAIAGAFNGVLVAYARLAPFIVTLGTMTLFRGLTEIYTNGQPIFNLPYSFNGLGNGAVLGVPVPVWITMIVFLIAWMVLSRTVAGRRIYAIGGNEKVAYLAGVRAKRYLVAVYVVSGILAALAGLILTSRLATAEPTAGQGYELDAITAVVLGGTSLFGGEGTLVGTIIGALILGVIDNGLNLLNVSSFYQDAVKGLVILIAIMLDRKRSEGR

SEQ ID NO: 349 - protein, 309 aa, Artificial
  Substituion in SEQ ID NO 341
MTWFRRYRIGPLLGLVLLILILAVASRQFFTASNLLDIALQTSVNALLAIGMTFVILTAGIDLSVGSTLALTSAIAAQWMVGGTSPWLAGISALCIGAIAGAFNGVLVAYARLAPFIVTLGTMTLFRGLTEIYTNGQPIFNLPYSFNGLGNGAVLGVPVPVWITMIVFLIAWMVLSRTVAGRRIYAIGGNEKVAYLAGVRAKRYLVAVYVVSGILAALAGLILTSRLATAEPTAGQGYELDAITAVVLGGTSLFGGEGTLVGTIIGALILGVIDNGLNLLNVSSFYQDAVKGLVILIAIMLDRKRSEGR

SEQ ID NO: 350 - protein, 309 aa, Artificial
  Substituion in SEQ ID NO 341
MTWFRRYRLGPLLGLVLLILILAVASRQFFTASNLLDIAIQTSVNALLAIGMTFVILTAGIDLSVGSTLALTSAIAAQWMVGGTSPWLAGISALCIGAIAGAFNGVLVAYARLAPFIVTLGTMTLFRGLTEIYTNGQPIFNLPYSFNGLGNGAVLGVPVPVWITMIVFLIAWMVLSRTVAGRRIYAIGGNEKVAYLAGVRAKRYLVAVYVVSGILAALAGLILTSRLATAEPTAGQGYELDAITAVVLGGTSLFGGEGTLVGTIIGALILGVIDNGLNLLNVSSFYQDAVKGLVILIAIMLDRKRSEGR

SEQ ID NO: 351 - protein, 309 aa, Artificial
  Substituion in SEQ ID NO 341
MTWFRRYRLGPLLGLVLLILILAVASRQFFTASNLLDIALQTSVNALLAIGMTFVILTAGIDLSVGSTLALTSAIAAQWMVGGTSPWLAGISALCIGAIAGAFNGVLVAYARLAPFIVTLGTMTLFRGLTEIYTNGQPIFNLPYSFNGIGNGAVLGVPVPVWITMIVFLIAWMVLSRTVAGRRIYAIGGNEKVAYLAGVRAKRYLVAVYVVSGILAALAGLILTSRLATAEPTAGQGYELDAITAVVLGGTSLFGGEGTLVGTIIGALILGVIDNGLNLLNVSSFYQDAVKGLVILIAIMLDRKRSEGR

SEQ ID NO: 352 - protein, 309 aa, Artificial
  Substituion in SEQ ID NO 341
MTWFRRYRLGPLLGLVLLILILAVASRQFFTASNLLDIALQTSVNALLAIGMTFVILTAGIDLSVGSTLALTSAIAAQWMVGGTSPWLAGISALCIGAIAGAFNGVLVAYARLAPFIVTLGTMTLFRGLTEIYTNGQPIFNLPYSFNGLGNGAVLGVPVPVWITMIVFLIAWMVLSRTVAGRRIYAIGGNEKVAYLAGVRAKRYLVAVYVVSGILAALAGLILTSRLATADPTAGQGYELDAITAVVLGGTSLFGGEGTLVGTIIGALILGVIDNGLNLLNVSSFYQDAVKGLVILIAIMLDRKRSEGR

SEQ ID NO: 353 - DNA, 930 bp, Artificial
  Substituion in SEQ ID NO 342
atgacttggtttcgcaggtatcggttgggccctattctcgggttggttttgctcattctcatcctggctgtagcatctcggcagttcttcactgcgagtaacctgttggacattgcgttgcaaacatccgtgaatgcgctcttggccatcgggatgacgtttgtgatcctaacggccggaattgacctgtcggtaggatccacgctggcactgacatcggccatcgcggcacagtggatggtgggcggtacaagtccatggctggcaggcatatctgcgttatgcattggagccatcgccggagcgttcaatggtgtcctcgtggcctatgcacgtcttgcgcccttcatcgtcacacttggaacgatgacgttgtttcgtggtttaaccgaaatttatacgaacggtcaacccatttttaacctgccttattcctttaacgggctcgggaacggggcggttctaggagttcctgtccccgtctggatcacgatgatcgtgttccttatcgcatggatggttctctcgcgcactgtggcaggcagaaggatttatgccattggaggaaacgagaaagttgcgtacttggcgggggttcgcgccaagcgatatctggtggcggtctatgtggtcagtggtattttagcggcactggctggcctcattctcacttctcgtcttgcaactgccgaaccgaccgcagggcaaggttacgagctcgatgcaatcacggccgtcgtactcggtggaactagtcttttcggcggtgaggggactttagtcgggaccatcatcggcgcgctgattctcggtgtcattgacaacggtctgaacttgttaaatgtaagttccttctatcaagatgctgtcaagggcctcgttattctgatcgccatcatgttggaccgtaagagatccgaagggagataa

SEQ ID NO: 354 - DNA, 930 bp, Artificial
  Substituion in SEQ ID NO 342
atgacttggtttcgcaggtatcggattggccctcttctcgggttggttttgctcattctcatcctggctgtagcatctcggcagttcttcactgcgagtaacctgttggacattgcgttgcaaacatccgtgaatgcgctcttggccatcgggatgacgtttgtgatcctaacggccggaattgacctgtcggtaggatccacgctggcactgacatcggccatcgcggcacagtggatggtgggcggtacaagtccatggctggcaggcatatctgcgttatgcattggagccatcgccggagcgttcaatggtgtcctcgtggcctatgcacgtcttgcgcccttcatcgtcacacttggaacgatgacgttgtttcgtggtttaaccgaaatttatacgaacggtcaacccatttttaacctgccttattcctttaacgggctcgggaacggggcggttctaggagttcctgtccccgtctggatcacgatgatcgtgttccttatcgcatggatggttctctcgcgcactgtggcaggcagaaggatttatgccattggaggaaacgagaaagttgcgtacttggcgggggttcgcgccaagcgatatctggtggcggtctatgtggtcagtggtattttagcggcactggctggcctcattctcacttctcgtcttgcaactgccgaaccgaccgcagggcaaggttacgagctcgatgcaatcacggccgtcgtactcggtggaactagtcttttcggcggtgaggggactttagtcgggaccatcatcggcgcgctgattctcggtgtcattgacaacggtctgaacttgttaaatgtaagttccttctatcaagatgctgtcaagggcctcgttattctgatcgccatcatgttggaccgtaagagatccgaagggagataa

SEQ ID NO: 355 - DNA, 930 bp, Artificial
  Substituion in SEQ ID NO 342
atgacttggtttcgcaggtatcggttgggccctcttctcgggttggttttgctcattctcatcctggctgtagcatctcggcagttcttcactgcgagtaacctgttggacattgcgattcaaacatccgtgaatgcgctcttggccatcgggatgacgtttgtgatcctaacggccggaattgacctgtcggtaggatccacgctggcactgacatcggccatcgcggcacagtggatggtgggcggtacaagtccatggctggcaggcatatctgcgttatgcattggagccatcgccggagcgttcaatggtgtcctcgtggcctatgcacgtcttgcgcccttcatcgtcacacttggaacgatgacgttgtttcgtggtttaaccgaaatttatacgaacggtcaacccatttttaacctgccttattcctttaacgggctcgggaacggggcggttctaggagttcctgtccccgtctggatcacgatgatcgtgttccttatcgcatggatggttctctcgcgcactgtggcaggcagaaggatttatgccattggaggaaacgagaaagttgcgtacttggcgggggttcgcgccaagcgatatctggtggcggtctatgtggtcagtggtattttagcggcactggctggcctcattctcacttctcgtcttgcaactgccgaaccgaccgcagggcaaggttacgagctcgatgcaatcacggccgtcgtactcggtggaactagtcttttcggcggtgaggggactttagtcgggaccatcatcggcgcgctgattctcggtgtcattgacaacggtctgaacttgttaaatgtaagttccttctatcaagatgctgtcaagggcctcgttattctgatcgccatcatgttggaccgtaagagatccgaagggagataa

SEQ ID NO: 356 - DNA, 930 bp, Artificial
  Substituion in SEQ ID NO 342
atgacttggtttcgcaggtatcggttgggccctcttctcgggttggttttgctcattctcatcctggctgtagcatctcggcagttcttcactgcgagtaacctgttggacattgcgttgcaaacatccgtgaatgcgctcttggccatcgggatgacgtttgtgatcctaacggccggaattgacctgtcggtaggatccacgctggcactgacatcggccatcgcggcacagtggatggtgggcggtacaagtccatggctggcaggcatatctgcgttatgcattggagccatcgccggagcgttcaatggtgtcctcgtggcctatgcacgtcttgcgcccttcatcgtcacacttggaacgatgacgttgtttcgtggtttaaccgaaatttatacgaacggtcaacccatttttaacctgccttattcctttaacgggattgggaacggggcggttctaggagttcctgtccccgtctggatcacgatgatcgtgttccttatcgcatggatggttctctcgcgcactgtggcaggcagaaggatttatgccattggaggaaacgagaaagttgcgtacttggcgggggttcgcgccaagcgatatctggtggcggtctatgtggtcagtggtattttagcggcactggctggcctcattctcacttctcgtcttgcaactgccgaaccgaccgcagggcaaggttacgagctcgatgcaatcacggccgtcgtactcggtggaactagtcttttcggcggtgaggggactttagtcgggaccatcatcggcgcgctgattctcggtgtcattgacaacggtctgaacttgttaaatgtaagttccttctatcaagatgctgtcaagggcctcgttattctgatcgccatcatgttggaccgtaagagatccgaagggagataa

SEQ ID NO: 357 - DNA, 930 bp, Artificial
  Substituion in SEQ ID NO 342
atgacttggtttcgcaggtatcggttgggccctcttctcgggttggttttgctcattctcatcctggctgtagcatctcggcagttcttcactgcgagtaacctgttggacattgcgttgcaaacatccgtgaatgcgctcttggccatcgggatgacgtttgtgatcctaacggccggaattgacctgtcggtaggatccacgctggcactgacatcggccatcgcggcacagtggatggtgggcggtacaagtccatggctggcaggcatatctgcgttatgcattggagccatcgccggagcgttcaatggtgtcctcgtggcctatgcacgtcttgcgcccttcatcgtcacacttggaacgatgacgttgtttcgtggtttaaccgaaatttatacgaacggtcaacccatttttaacctgccttattcctttaacgggctcgggaacggggcggttctaggagttcctgtccccgtctggatcacgatgatcgtgttccttatcgcatggatggttctctcgcgcactgtggcaggcagaaggatttatgccattggaggaaacgagaaagttgcgtacttggcgggggttcgcgccaagcgatatctggtggcggtctatgtggtcagtggtattttagcggcactggctggcctcattctcacttctcgtcttgcaactgccgatccgaccgcagggcaaggttacgagctcgatgcaatcacggccgtcgtactcggtggaactagtcttttcggcggtgaggggactttagtcgggaccatcatcggcgcgctgattctcggtgtcattgacaacggtctgaacttgttaaatgtaagttccttctatcaagatgctgtcaagggcctcgttattctgatcgccatcatgttggaccgtaagagatccgaagggagataa

SEQ ID NO: 358 - protein, 315 aa, Alicyclobacillus acidocaldarius
MTMSVIDAFLRSTAQTAAEPSPGPSRLREGILAACLLAPALLFLVAFVYAPAVLAFALAFFNFHPGGTATYAGLSNFHAALSDPLFWRSMANTGLYALMMVPSTLVLSVALAALLQSNRRLFRFAQSLVVLPYITPAVGTAIGWLWMYNPNFGILNALLRGIGLKPIGWLNSPHWAMPAVVLYSLWHGIGFDVLILLSAMSQVPEGVLESARVDGAGPWTRLFRITLPLISPTLFFIGVITTIGSLQAFAQVYALSLSSGGPENATLTALLYIYQQAFTNGQFSYAAAMAAMLVVCIFAVTALTRWIGHRLTFYQ

SEQ ID NO: 359 - DNA, 948 bp, Alicyclobacillus acidocaldarius
atgaccatgtcggtaatcgacgcgttccttcgctcgacagcgcagaccgccgccgaaccttccccaggcccatcccgcctgcgggaaggaattttggcggcgtgccttctcgcgcccgcccttctgtttctcgtggcgtttgtctatgcgccggccgtgctcgcctttgcgctcgcgttcttcaattttcaccccggcggcacggcgacctacgccggtctgagcaacttccatgcggcattgtcggatccgcttttctggcgctccatggcaaacacagggttgtacgccctcatgatggtgccttccaccctggtgctgtccgtcgcactcgcggcgctgctccagtcgaaccggcggctcttccgcttcgcgcagtcgttggtggtgctcccgtacatcacgccggccgtcggcaccgctatcggatggctctggatgtacaaccccaacttcggcatcttgaacgcgcttttgcgaggcatcggcctgaagcccatcggatggttgaattcgccccactgggcgatgcccgccgtggtcttatattcgctttggcacggcatcggctttgatgtgctgatcctgctctccgccatgtctcaggtgccagaaggcgtgttggagtcggcgcgggtagacggcgcggggccttggactcggttgttccgcatcacgctgcccctcatctcgcccacgctgtttttcatcggcgtgatcaccaccatcggctctctgcaggcctttgcccaggtctacgcactgagtctttcgagcggcggaccggagaacgccacgctgacggcgcttttatacatctaccaacaggcgttcacgaacggacagttctcttacgccgccgccatggccgcgatgctcgtggtctgcatctttgcagtcaccgccctgacgcgctggatcggtcaccgattgacgttttaccagtaa

SEQ ID NO: 360 - protein, 231 aa, Methylococcus capsulatus str. Bath
FVGLDNYRRLFGDPEFWQALRNTLYFVAVGGPLSVLVSLAAALLVNHRLAPFKGLFRSLLFLPVVTTLVAVAVVWRYMYQPRYGILNHLLGRFGLEPVDWLGDPDWAMPAIIVMAVWKNFGFNMIVFVAGLQSIPESLYEAASIDGAGHRRQFFHITLPLLAPTFLFVAVITVIGHFQLFAEPYVMTQGGPAGSTLSLALLMYQQGFRWWNLGYAAAIAFVLFGIVGSFAV

SEQ ID NO: 361 - protein, 234 aa, Petrotoga mobilis SJ95
GNASFIGFENYVNLMHDPLFWRALLNTLYALVVAMPITIVLSLSFAALINREATYFKNFFKVSFYLPSITNTVAIAIVWAWMLNPDYGLLNWFLGLFGIQGPNWLGDPLWAMPSVIMLVVWKAVGYNIILFTAGLQNIPDYLYEAAELDGASRFQQFLHVTIPSLRPTIFFVTVMTVIGYLQLFEEPYMLTSGGPLNATLSIVLYLYRQGFEFFKLGYSSSIAFVLFLIIFALT

SEQ ID NO: 362 - protein, 242 aa, Clostridium botulinum A str. ATCC 3502
GLDNFYYIFSDKEFLIAMKNTFIYVLYVMPISIILSLIIAILLNSNIKFRGFFRTIYFIPFITSTVAISMVWRWMYHADHGIINYLLQVIGLSPVKWLSDPKWAMPSLIILSIWKSLGYNIVIFLAGLQNIDEQYNLAAKLDGANKWERIKNITVPLLSPTIFFVCIMTLISSFKVFGEIFALFDKQPGPLNTCLTMVYYIYNKFYNQYQYGIASAAVFVLFIIISLFNFIQFYIGKKKVEY

SEQ ID NO: 363 - protein, 242 aa, Clostridium botulinum F str. Langeland
GLDNFYYIFSDKEFLIAMKNTFIYVLYVMPISIILSLIIAILLNSNIKFRGFFRTVYFIPFITSTVAISMVWRWMYHADHGIINYLLQVIGLSPVKWLSDPKWAMPSLIILSIWKSLGYNIVIFLAGLQNIDEQYNLAAKLDGANKWERIKNITVPLLSPTIFFVCIMTLISSFKVFGEIFALFDKQPGPLNTCLTMVYYIYNKFYNQYQYGIASAAVFVLFIIISLFNFIQFYIGKKKVEY

SEQ ID NO: 364 - protein, 228 aa, Roseiflexus sp. RS-1
GLANYEKLFNDKLFWQSLRVSAIYSIVSVPLGLTIALGLALLLNHKMRGIMVFRSVYYLPTVISGVGVAMLWRWLFNGDFGIINVLLRGVGIRGPNWLFDETWALVALIIASLWGIGGTMLIFLAGLQGIPQELYEAAEIDGAGRWRQFSSITLPMISHVTFFNLVLGVIGALQVFTDAYVITGGGPNNATLFLSVYLYRHAFQYLNFGYAAAVAWVLFLIVLALTLL

SEQ ID NO: 365 - protein, 315 aa, Artificial
  Substituion in SEQ ID NO 358
MTMSVIDAFLRSTAQTAAEPSPGPSRLREGILAACLLAPALLFLVAFVYAPAVLAFALAFFNFHPGGTATYAGLSNFHAALSDPLFWRSMANTGLYALMMVPSTLVLSVALAALLQSNRRLFRFAQSLVVLPYITPAVGTAIGWLWMYNPNFGILNALLRGIGLKPIGWLNSPHWAMPAVVLYSLWHGIGFDVLILLSAMSQVPEGVLESARVDGAGPWTRLFRITLPLISPTLFFIGVITTIGSLQAFAQVYALSLSSGGPDNATLTALLYIYQQAFTNGQFSYAAAMAAMLVVCIFAVTALTRWIGHRLTFYQ

SEQ ID NO: 366 - protein, 315 aa, Artificial
  Substituion in SEQ ID NO 358
MTMSVIDAFLRSTAQTAAEPSPGPSRLREGILAACLLAPALLFLVAFVYAPAVLAFALAFFNFHPGGTATYAGLSNFHAALSDPLFWRSMANTGLYALMMVPSTLVLSVALAALLQSNRRLFRFAQSLVVLPYITPAVGTAIGWLWMYNPNFGILNALLRGIGLKPIGWLNSPHWAMPAVVLYSLWHGIGFEVLILLSAMSQVPEGVLESARVDGAGPWTRLFRITLPLISPTLFFIGVITTIGSLQAFAQVYALSLSSGGPENATLTALLYIYQQAFTNGQFSYAAAMAAMLVVCIFAVTALTRWIGHRLTFYQ

SEQ ID NO: 367 - protein, 315 aa, Artificial
  Substituion in SEQ ID NO 358
MTMSVIDAFLRSTAQTAAEPSPGPSRLREGILAACLLAPALLFLVAFVYAPAVLAFALAFFNFHPGGTATYAGLSNFHAALSDPLFWRSMANTGLYALMMVPSTLVLSVALAALLQSNRRLFRFAQSLVVLPYITPAVGTAIGWLWMYNPNFGILNALLRGIGLKPIGWLNSPHWAMPAVVLYSLWHGIGFDVLILLSAMSQVPEGVLESARVDGAGPWTRLFRITLPLISPTLFFIGVITTIGSLQAFAQVYALSLSSGGPENATLTALLYIYQQAFTQGQFSYAAAMAAMLVVCIFAVTALTRWIGHRLTFYQ

SEQ ID NO: 368 - protein, 315 aa, Artificial
  Substituion in SEQ ID NO 358
MTMSVIDAFLRSTAQTAAEPSPGPSRLREGILAACLLAPALLFLVAFVYAPAVLAFALAFFNFHPGGTATYAGLSNFHAALSDPLFWRSMANTGLYALMMVPSTLVLSVALAALLQSNRRLFRFAQSLVVLPYITPAVGTAIGWLWMYNPNFGILNALLRGIGLKPIGWLNSPHWAMPAVVLYSLWHGIGFDVLILLSAMSQVPEGVLDSARVDGAGPWTRLFRITLPLISPTLFFIGVITTIGSLQAFAQVYALSLSSGGPENATLTALLYIYQQAFTNGQFSYAAAMAAMLVVCIFAVTALTRWIGHRLTFYQ

SEQ ID NO: 369 - protein, 315 aa, Artificial
  Substituion in SEQ ID NO 358
MTMSVIDAFLRSTAQTAAEPSPGPSRLREGILAACLLAPALLFLVAFVYAPAVLAFALAFFNFHPGGTATYAGLSNFHAALSDPLFWRSMANTGLYALMMVPSTLVLSVALAALIQSNRRLFRFAQSLVVLPYITPAVGTAIGWLWMYNPNFGILNALLRGIGLKPIGWLNSPHWAMPAVVLYSLWHGIGFDVLILLSAMSQVPEGVLESARVDGAGPWTRLFRITLPLISPTLFFIGVITTIGSLQAFAQVYALSLSSGGPENATLTALLYIYQQAFTNGQFSYAAAMAAMLVVCIFAVTALTRWIGHRLTFYQ

SEQ ID NO: 370 - DNA, 948 bp, Artificial
  Substituion in SEQ ID NO 359
atgaccatgtcggtaatcgacgcgttccttcgctcgacagcgcagaccgccgccgaaccttccccaggcccatcccgcctgcgggaaggaattttggcggcgtgccttctcgcgcccgcccttctgtttctcgtggcgtttgtctatgcgccggccgtgctcgcctttgcgctcgcgttcttcaattttcaccccggcggcacggcgacctacgccggtctgagcaacttccatgcggcattgtcggatccgcttttctggcgctccatggcaaacacagggttgtacgccctcatgatggtgccttccaccctggtgctgtccgtcgcactcgcggcgctgctccagtcgaaccggcggctcttccgcttcgcgcagtcgttggtggtgctcccgtacatcacgccggccgtcggcaccgctatcggatggctctggatgtacaaccccaacttcggcatcttgaacgcgcttttgcgaggcatcggcctgaagcccatcggatggttgaattcgccccactgggcgatgcccgccgtggtcttatattcgctttggcacggcatcggctttgatgtgctgatcctgctctccgccatgtctcaggtgccagaaggcgtgttggagtcggcgcgggtagacggcgcggggccttggactcggttgttccgcatcacgctgcccctcatctcgcccacgctgtttttcatcggcgtgatcaccaccatcggctctctgcaggcctttgcccaggtctacgcactgagtctttcgagcggcggaccggataacgccacgctgacggcgcttttatacatctaccaacaggcgttcacgaacggacagttctcttacgccgccgccatggccgcgatgctcgtggtctgcatctttgcagtcaccgccctgacgcgctggatcggtcaccgattgacgttttaccagtaa

SEQ ID NO: 371 - DNA, 948 bp, Artificial
  Substituion in SEQ ID NO 359
atgaccatgtcggtaatcgacgcgttccttcgctcgacagcgcagaccgccgccgaaccttccccaggcccatcccgcctgcgggaaggaattttggcggcgtgccttctcgcgcccgcccttctgtttctcgtggcgtttgtctatgcgccggccgtgctcgcctttgcgctcgcgttcttcaattttcaccccggcggcacggcgacctacgccggtctgagcaacttccatgcggcattgtcggatccgcttttctggcgctccatggcaaacacagggttgtacgccctcatgatggtgccttccaccctggtgctgtccgtcgcactcgcggcgctgctccagtcgaaccggcggctcttccgcttcgcgcagtcgttggtggtgctcccgtacatcacgccggccgtcggcaccgctatcggatggctctggatgtacaaccccaacttcggcatcttgaacgcgcttttgcgaggcatcggcctgaagcccatcggatggttgaattcgccccactgggcgatgcccgccgtggtcttatattcgctttggcacggcatcggctttgaagtgctgatcctgctctccgccatgtctcaggtgccagaaggcgtgttggagtcggcgcgggtagacggcgcggggccttggactcggttgttccgcatcacgctgcccctcatctcgcccacgctgtttttcatcggcgtgatcaccaccatcggctctctgcaggcctttgcccaggtctacgcactgagtctttcgagcggcggaccggagaacgccacgctgacggcgcttttatacatctaccaacaggcgttcacgaacggacagttctcttacgccgccgccatggccgcgatgctcgtggtctgcatctttgcagtcaccgccctgacgcgctggatcggtcaccgattgacgttttaccagtaa

SEQ ID NO: 372 - DNA, 948 bp, Artificial
  Substituion in SEQ ID NO 359
atgaccatgtcggtaatcgacgcgttccttcgctcgacagcgcagaccgccgccgaaccttccccaggcccatcccgcctgcgggaaggaattttggcggcgtgccttctcgcgcccgcccttctgtttctcgtggcgtttgtctatgcgccggccgtgctcgcctttgcgctcgcgttcttcaattttcaccccggcggcacggcgacctacgccggtctgagcaacttccatgcggcattgtcggatccgcttttctggcgctccatggcaaacacagggttgtacgccctcatgatggtgccttccaccctggtgctgtccgtcgcactcgcggcgctgctccagtcgaaccggcggctcttccgcttcgcgcagtcgttggtggtgctcccgtacatcacgccggccgtcggcaccgctatcggatggctctggatgtacaaccccaacttcggcatcttgaacgcgcttttgcgaggcatcggcctgaagcccatcggatggttgaattcgccccactgggcgatgcccgccgtggtcttatattcgctttggcacggcatcggctttgatgtgctgatcctgctctccgccatgtctcaggtgccagaaggcgtgttggagtcggcgcgggtagacggcgcggggccttggactcggttgttccgcatcacgctgcccctcatctcgcccacgctgtttttcatcggcgtgatcaccaccatcggctctctgcaggcctttgcccaggtctacgcactgagtctttcgagcggcggaccggagaacgccacgctgacggcgcttttatacatctaccaacaggcgttcacgcaaggacagttctcttacgccgccgccatggccgcgatgctcgtggtctgcatctttgcagtcaccgccctgacgcgctggatcggtcaccgattgacgttttaccagtaa

SEQ ID NO: 373 - DNA, 948 bp, Artificial
  Substituion in SEQ ID NO 359
atgaccatgtcggtaatcgacgcgttccttcgctcgacagcgcagaccgccgccgaaccttccccaggcccatcccgcctgcgggaaggaattttggcggcgtgccttctcgcgcccgcccttctgtttctcgtggcgtttgtctatgcgccggccgtgctcgcctttgcgctcgcgttcttcaattttcaccccggcggcacggcgacctacgccggtctgagcaacttccatgcggcattgtcggatccgcttttctggcgctccatggcaaacacagggttgtacgccctcatgatggtgccttccaccctggtgctgtccgtcgcactcgcggcgctgctccagtcgaaccggcggctcttccgcttcgcgcagtcgttggtggtgctcccgtacatcacgccggccgtcggcaccgctatcggatggctctggatgtacaaccccaacttcggcatcttgaacgcgcttttgcgaggcatcggcctgaagcccatcggatggttgaattcgccccactgggcgatgcccgccgtggtcttatattcgctttggcacggcatcggctttgatgtgctgatcctgctctccgccatgtctcaggtgccagaaggcgtgttggattcggcgcgggtagacggcgcggggccttggactcggttgttccgcatcacgctgcccctcatctcgcccacgctgtttttcatcggcgtgatcaccaccatcggctctctgcaggcctttgcccaggtctacgcactgagtctttcgagcggcggaccggagaacgccacgctgacggcgcttttatacatctaccaacaggcgttcacgaacggacagttctcttacgccgccgccatggccgcgatgctcgtggtctgcatctttgcagtcaccgccctgacgcgctggatcggtcaccgattgacgttttaccagtaa

SEQ ID NO: 374 - DNA, 948 bp, Artificial
  Substituion in SEQ ID NO 359
atgaccatgtcggtaatcgacgcgttccttcgctcgacagcgcagaccgccgccgaaccttccccaggcccatcccgcctgcgggaaggaattttggcggcgtgccttctcgcgcccgcccttctgtttctcgtggcgtttgtctatgcgccggccgtgctcgcctttgcgctcgcgttcttcaattttcaccccggcggcacggcgacctacgccggtctgagcaacttccatgcggcattgtcggatccgcttttctggcgctccatggcaaacacagggttgtacgccctcatgatggtgccttccaccctggtgctgtccgtcgcactcgcggcgctgattcagtcgaaccggcggctcttccgcttcgcgcagtcgttggtggtgctcccgtacatcacgccggccgtcggcaccgctatcggatggctctggatgtacaaccccaacttcggcatcttgaacgcgcttttgcgaggcatcggcctgaagcccatcggatggttgaattcgccccactgggcgatgcccgccgtggtcttatattcgctttggcacggcatcggctttgatgtgctgatcctgctctccgccatgtctcaggtgccagaaggcgtgttggagtcggcgcgggtagacggcgcggggccttggactcggttgttccgcatcacgctgcccctcatctcgcccacgctgtttttcatcggcgtgatcaccaccatcggctctctgcaggcctttgcccaggtctacgcactgagtctttcgagcggcggaccggagaacgccacgctgacggcgcttttatacatctaccaacaggcgttcacgaacggacagttctcttacgccgccgccatggccgcgatgctcgtggtctgcatctttgcagtcaccgccctgacgcgctggatcggtcaccgattgacgttttaccagtaa

SEQ ID NO: 375 - protein, 459 aa, Alicyclobacillus acidocaldarius
MVLTQYSAIQRGRIHVRRSWVLGTASAVILAGAGTGVALDRGHAHDAVRVAPAEAASANGVVQITFWNGHPSGALKKEMHTLVDEFNATHPHIHVTVIDKYAQIQPVTAAMTAGDAPNVIMPHLDAAQQFAADGYLVNLTPYIDGPSGFTKAQLSSFFYPSVWNGRAIEPGKQYILPFEENGHMVIFYNADLFKKAGISSPPKTWQQLRADARKITALGGSIHGIAWTPSMEQFLTMVADNSGKIWASSSETRFALNNPQAVATLSFLRDLVAQGDMILTQNYDYQLDFGTGNIGLLIESSAGWTYDVQSVGGKFPVKASPAPAGTSGRAYNYVDGDSLAILNTGTKAQQDAAWTFIRWLASPAENAQWDQAANYLPIGPAAAAQLKPYYASHPDQAAAFTNPSTWLTDPAANATQYYAALTAMQTELLKALNGQESPQQAIANMNTVGNQYLSGERRS

SEQ ID NO: 376 - DNA, 1380 bp, Alicyclobacillus acidocaldarius
atggtcttgacccaatattcggccattcaaagggggagaattcacgtgagacgaagctgggttctcggcaccgcatccgccgtgatcttggcgggcgcgggaaccggtgtggcactcgatcgcgggcacgcgcacgacgcggttcgcgtggcgcctgcggaagcggcgagcgcaaacggagtcgttcagatcacattttggaacgggcatccttctggcgcgctgaagaaggagatgcacacccttgtcgacgagttcaacgccacccatcctcacatccatgtcacggttatcgacaagtacgcgcagattcagcccgtcaccgccgcaatgaccgctggcgatgcgccgaacgtgatcatgcctcacctcgatgccgctcagcagttcgcggcagacggctacctcgtgaacctgacgccgtacatcgacggaccgagcggtttcacgaaggctcaactctcctcgttcttctatccctctgtctggaacggccgcgccatcgagccgggcaaacaatacatcctcccgttcgaagaaaacgggcatatggtaatcttctacaacgcggatctgttcaagaaggcgggcatctcgtcgccgcccaagacgtggcagcagctcagggcggatgcgcggaagatcacggcgctcggcggaagcatccacggcattgcatggaccccctccatggagcaattcctgacgatggtcgcagacaacagcggaaagatttgggcatccagcagcgagacgcggttcgccctgaacaacccgcaggccgtcgccaccctctcctttttgcgcgatctcgtcgcgcagggcgacatgatcctcacccaaaactacgactatcaattggattttggcacgggcaacatcggtttgctcatcgaatcgtccgcagggtggacctatgacgtgcagtcggtcggcggcaagttcccggtcaaagcgtccccggcgcccgctggcacgtccggccgcgcgtacaactacgtcgacggcgacagcctcgccattttgaacacgggaaccaaggcgcagcaggatgcggcgtggacgttcattcgctggctcgcgagccccgcggaaaacgcgcagtgggatcaggcggcgaattaccttcccatcggacccgctgcagcagcccagctgaaaccgtactatgcttcccatcccgaccaggcggccgccttcacgaatccatccacatggctgacggatccggccgcgaacgcgacgcaatactacgccgcgctgaccgccatgcagactgaactgctgaaggcgctcaacgggcaggaatcgccgcaacaggccatcgcgaacatgaataccgtcggcaatcaatacctgagcggcgagcgcaggagctga

SEQ ID NO: 377 - protein, 391 aa, Symbiobacterium thermophilum IAM 14863
VKVTFWHAMGGVAGEAVQRLVDQFNSSQDKVEVEAVYQGTYDDALQKLRAAGSDGPTIMQVYEIGSRFMIDSGMITPMQNFVDADGFSIDDFEPNILGYYTFDGRLYSMPFNTSTPIVYYNKDAFREAGLDPERPPRTFEEFKEYARKLTVTQGGETRYGASIALYGWFFEQFLAVQGAHYVDNDNGRSARATKAIINSPEGERFVTWLKEMVDEGVAINLGRRTADTQAAFSSGQVAMTLDSTAALGNILNGVGDKFEIGTAFLPRPEGAAEGGVIIGGASLWITNTKPLKEQWAAWEFVKWLTTPEVQAEWSIATGYFPVRKAAYDQQILKDWHAQRPQFTTAIEQLRASPLSTVTQGAVIGTFPQARQIVEAAMESVVLGQATAAEAL

SEQ ID NO: 378 - protein, 328 aa, Renibacterium salmoninarum ATCC 33209
VTISFMHAMSTGALKTSLTKITQDFMAKNPNITVDLQEQPDYATLQTKINAQTAAGTPPMIAQVYSNLADEFASSKVIVPLDDYVSQSKDYGNFYDGVKKDLKLTDGKTRMWPFNKSVVVQYYNPTMVPEAPKTWDDFATAAKKASTGNVVALSIDPGNSSGPAGGTALFEIMAQSFGDPVFASDGTPQFTKDGVVKALDYLKQMKKDGSLALGTKYPGQAALGGQTGAFDISSVASYQFNKAAVGDKFAMGVAALPSGPAGTANQLAGTKIALFDKSTDAQKAAAWKFMQFLTSPEEMAYWSSTTGYLPVSKDTLDQPVFKDYVAKN

SEQ ID NO: 379 - protein, 388 aa, Clostridium difficile 630
SNITKIDFWAPLGGTNGETAQKMVDQFNSEHKDVQVNMLKQKDYYENATKLQAALTSKDQPDVTLLEITQTGTFASAGALVDMSKYFDKTYQERFFSGLLTNSYYEDKFVGMPFNRSTPILYINKDMATKAGLDPSGPKSWEELKDYASKMTNKSEDTYGFETPIDIWFYEAMVMQSGGEITNGKKVAFNNEAGQAPVKFWQDMMKAGIMKMPPGEDYNAWDVAKQDFVNGKVGMIFTSTADLAGLMQQTEGKFEISTAFLPKNQKYATPTGGANLVMLEGGTDKEKEASAEFIEWMTQTDKIVQFSSSTGYLPTTEDATNSEKLQTLYKEKPQYKVATDQLQYAVALPMLNGYKEATDKLMDEIKKGLTDLNANPKDVVSKGTSAMQ

SEQ ID NO: 380 - protein, 388 aa, Clostridium difficile QCD-32g58
SNITKIDFWAPLGGTNGETAQKMVDQFNSEHKDVQVNMLKQKDYYENATKLQAALTSKDQPDVTLLEITQTGTFASAGALVDMSKYFDKTYQERFFSGLLTNSYYEDKFVGMPFNRSTPILYINRDMATKAGLDPSGPKSWEELKDYASKMTNKSEDTYGFETPIDIWFYEAMVMQSGGEITNGKKVAFNNEAGQAPVKFWQDMMKAGIMKMPPGEDYNAWDVAKQDFVNGKVGMIFTSTADLAGLMQQTEGKFEISTAFLPKNQKYATPTGGANLVMLEGGTDKEKEASAEFIEWMTQTDKIVQFSSSTGYLPTTEDATNSEKLQTLYKEKPQYKVATDQLQYAVALPMLNGYKEATDKLMDEIKKGLTDLNANPKDVVSKGTSAMQ

SEQ ID NO: 381 - protein, 389 aa, Methylobacterium sp. 4-46
GALARTMTGLVKEFNEAHPGTRVTPVFTGSYDDTLLKTRAAIKAGKPPGAVIMSANFLTDLAIEREIAPFDDLIAAEGGTPDAFMDQFFPALKGNAVVERKVYGVPFHNSTPLLYYNVEQFREAGLDPDAPPRTWDALAAAARKLTRREGGRVTRWGIMMPSNYDYGGWILQALTLSNGGRWYNEEYGGEVYYDTPTVLGALSFWADLVHRAKVHPAGEIKGPAVTAAFLSGQAAMMIISTGSLTFIRDSAKFPFRVAFVPMNVRPAVPIGGASLVQPTGLDPETRKAGWTLIRWLTSPAISGRWSRATGYFAPNRAAYDLPEMRAFLAGNPDAKIAVDQLANAKPWFATYRTVPVRKAIEDELQAVLAGKRQPKEALAAAQTSADAIL

SEQ ID NO: 382 - protein, 459 aa, Artificial
  Substituion in SEQ ID NO 375
MVLTQYSAIQRGRIHVRRSWVLGTASAVILAGAGTGVALDRGHAHDAVRVAPAEAASANGVVQITFWNGHPSGALKKEMHTLVDEFNATHPHIHVTVIDKYAQIQPVTAAMTAGDAPNVIMPHLDAAQQFAADGYLVNLTPYIDGPSGFTKAQLSSFFYPSIWNGRAIEPGKQYILPFEENGHMVIFYNADLFKKAGISSPPKTWQQLRADARKITALGGSIHGIAWTPSMEQFLTMVADNSGKIWASSSETRFALNNPQAVATLSFLRDLVAQGDMILTQNYDYQLDFGTGNIGLLIESSAGWTYDVQSVGGKFPVKASPAPAGTSGRAYNYVDGDSLAILNTGTKAQQDAAWTFIRWLASPAENAQWDQAANYLPIGPAAAAQLKPYYASHPDQAAAFTNPSTWLTDPAANATQYYAALTAMQTELLKALNGQESPQQAIANMNTVGNQYLSGERRS

SEQ ID NO: 383 - protein, 459 aa, Artificial
  Substituion in SEQ ID NO 375
MVLTQYSAIQRGRIHVRRSWVLGTASAVILAGAGTGVALDRGHAHDAVRVAPAEAASANGVVQITFWNGHPSGALKKEMHTLVDEFNATHPHIHVTVIDKYAQIQPVTAAMTAGDAPNVIMPHLDAAQQFAADGYLVNLTPYIDGPSGFTKAQLSSFFYPSVWNGRAIEPGKQYILPFEENGHMVIFYNADLFKKAGISSPPKTWQQLRADARKITALGGSIHGIAWTPSMEQFLTMVADNSGKIWASSSETRFALNNPQAVATLSFLRDLVAQGDMILTQNYDYQLDFGTGNIGLLIESSAGWTYDVQSVGGKFPVKASPAPAGTSGRAYNYVDGDSLAILNTGTKAQQDAAWTFIRWLASPAENAQWEQAANYLPIGPAAAAQLKPYYASHPDQAAAFTNPSTWLTDPAANATQYYAALTAMQTELLKALNGQESPQQAIANMNTVGNQYLSGERRS

SEQ ID NO: 384 - protein, 459 aa, Artificial
  Substituion in SEQ ID NO 375
MVLTQYSAIQRGRIHVRRSWVLGTASAVILAGAGTGVALDRGHAHDAVRVAPAEAASANGVVQITFWNGHPSGALKKEMHTLVDEFNATHPHIHVTVIDKYAQIQPVTAAMTAGDAPNVIMPHLDAAQQFAADGYLVNLTPYIDGPSGFTKAQLSSFFYPSVWNGRAIEPGKQYILPFEENGHMVIFYNADLFKKAGISSPPKTWQQLRADARKITALGGSIHGIAWTPSMEQFLTMVADNSGKIWASSSETRFALNNPQAVATLSFLRDLVAQGDMILTQNYDYQLDFGTGNIGLLIESSAGWTYDVQSVGGKFPVKASPAPAGTSGRAYNYVDGDSLAILNTGTKAQQDAAWTFIRWLASPAENAQWDQAANYLPIGPAAAAQLKPYYASHPDQAAAFTNPSTWLTDPAANATQYYAALTAMQTELLKALNGQESPQQAIANMNTVGNQYLSGDRRS

SEQ ID NO: 385 - protein, 459 aa, Artificial
  Substituion in SEQ ID NO 375
MVLTQYSAIQRGRIHVRRSWVLGTASAVILAGAGTGVALDRGHAHDAVRVAPAEAASANGVVQITFWNGHPSGALKKEMHTLVDEFNATHPHIHVTVIDKYAQIQPVTAAMTAGDAPNVIMPHLDAAQQFAADGYLVNLTPYIDGPSGFTKAQLSSFFYPSVWNGRAIEPGKQYILPFEENGHMVIFYNADLFKKAGISSPPKTWQQLRADARKITALGGSIHGIAWTPSMEQFLTMVADNSGKIWASSSETRFALNNPQAVATLSFLRDLVAQGDMILTQNYDYQLDFGTGNIGLLIESSAGWTYDVQSVGGKFPVKASPAPAGTSGRAYNYVDGDSLAIINTGTKAQQDAAWTFIRWLASPAENAQWDQAANYLPIGPAAAAQLKPYYASHPDQAAAFTNPSTWLTDPAANATQYYAALTAMQTELLKALNGQESPQQAIANMNTVGNQYLSGERRS

SEQ ID NO: 386 - protein, 459 aa, Artificial
  Substituion in SEQ ID NO 375
MVLTQYSAIQRGRIHVRRSWVLGTASAVILAGAGTGVAIDRGHAHDAVRVAPAEAASANGVVQITFWNGHPSGALKKEMHTLVDEFNATHPHIHVTVIDKYAQIQPVTAAMTAGDAPNVIMPHLDAAQQFAADGYLVNLTPYIDGPSGFTKAQLSSFFYPSVWNGRAIEPGKQYILPFEENGHMVIFYNADLFKKAGISSPPKTWQQLRADARKITALGGSIHGIAWTPSMEQFLTMVADNSGKIWASSSETRFALNNPQAVATLSFLRDLVAQGDMILTQNYDYQLDFGTGNIGLLIESSAGWTYDVQSVGGKFPVKASPAPAGTSGRAYNYVDGDSLAILNTGTKAQQDAAWTFIRWLASPAENAQWDQAANYLPIGPAAAAQLKPYYASHPDQAAAFTNPSTWLTDPAANATQYYAALTAMQTELLKALNGQESPQQAIANMNTVGNQYLSGERRS

SEQ ID NO: 387 - DNA, 1380 bp, Artificial
  Substituion in SEQ ID NO 376
atggtcttgacccaatattcggccattcaaagggggagaattcacgtgagacgaagctgggttctcggcaccgcatccgccgtgatcttggcgggcgcgggaaccggtgtggcactcgatcgcgggcacgcgcacgacgcggttcgcgtggcgcctgcggaagcggcgagcgcaaacggagtcgttcagatcacattttggaacgggcatccttctggcgcgctgaagaaggagatgcacacccttgtcgacgagttcaacgccacccatcctcacatccatgtcacggttatcgacaagtacgcgcagattcagcccgtcaccgccgcaatgaccgctggcgatgcgccgaacgtgatcatgcctcacctcgatgccgctcagcagttcgcggcagacggctacctcgtgaacctgacgccgtacatcgacggaccgagcggtttcacgaaggctcaactctcctcgttcttctatccctctatttggaacggccgcgccatcgagccgggcaaacaatacatcctcccgttcgaagaaaacgggcatatggtaatcttctacaacgcggatctgttcaagaaggcgggcatctcgtcgccgcccaagacgtggcagcagctcagggcggatgcgcggaagatcacggcgctcggcggaagcatccacggcattgcatggaccccctccatggagcaattcctgacgatggtcgcagacaacagcggaaagatttgggcatccagcagcgagacgcggttcgccctgaacaacccgcaggccgtcgccaccctctcctttttgcgcgatctcgtcgcgcagggcgacatgatcctcacccaaaactacgactatcaattggattttggcacgggcaacatcggtttgctcatcgaatcgtccgcagggtggacctatgacgtgcagtcggtcggcggcaagttcccggtcaaagcgtccccggcgcccgctggcacgtccggccgcgcgtacaactacgtcgacggcgacagcctcgccattttgaacacgggaaccaaggcgcagcaggatgcggcgtggacgttcattcgctggctcgcgagccccgcggaaaacgcgcagtgggatcaggcggcgaattaccttcccatcggacccgctgcagcagcccagctgaaaccgtactatgcttcccatcccgaccaggcggccgccttcacgaatccatccacatggctgacggatccggccgcgaacgcgacgcaatactacgccgcgctgaccgccatgcagactgaactgctgaaggcgctcaacgggcaggaatcgccgcaacaggccatcgcgaacatgaataccgtcggcaatcaatacctgagcggcgagcgcaggagctga

SEQ ID NO: 388 - DNA, 1380 bp, Artificial
  Substituion in SEQ ID NO 376
atggtcttgacccaatattcggccattcaaagggggagaattcacgtgagacgaagctgggttctcggcaccgcatccgccgtgatcttggcgggcgcgggaaccggtgtggcactcgatcgcgggcacgcgcacgacgcggttcgcgtggcgcctgcggaagcggcgagcgcaaacggagtcgttcagatcacattttggaacgggcatccttctggcgcgctgaagaaggagatgcacacccttgtcgacgagttcaacgccacccatcctcacatccatgtcacggttatcgacaagtacgcgcagattcagcccgtcaccgccgcaatgaccgctggcgatgcgccgaacgtgatcatgcctcacctcgatgccgctcagcagttcgcggcagacggctacctcgtgaacctgacgccgtacatcgacggaccgagcggtttcacgaaggctcaactctcctcgttcttctatccctctgtctggaacggccgcgccatcgagccgggcaaacaatacatcctcccgttcgaagaaaacgggcatatggtaatcttctacaacgcggatctgttcaagaaggcgggcatctcgtcgccgcccaagacgtggcagcagctcagggcggatgcgcggaagatcacggcgctcggcggaagcatccacggcattgcatggaccccctccatggagcaattcctgacgatggtcgcagacaacagcggaaagatttgggcatccagcagcgagacgcggttcgccctgaacaacccgcaggccgtcgccaccctctcctttttgcgcgatctcgtcgcgcagggcgacatgatcctcacccaaaactacgactatcaattggattttggcacgggcaacatcggtttgctcatcgaatcgtccgcagggtggacctatgacgtgcagtcggtcggcggcaagttcccggtcaaagcgtccccggcgcccgctggcacgtccggccgcgcgtacaactacgtcgacggcgacagcctcgccattttgaacacgggaaccaaggcgcagcaggatgcggcgtggacgttcattcgctggctcgcgagccccgcggaaaacgcgcagtgggaacaggcggcgaattaccttcccatcggacccgctgcagcagcccagctgaaaccgtactatgcttcccatcccgaccaggcggccgccttcacgaatccatccacatggctgacggatccggccgcgaacgcgacgcaatactacgccgcgctgaccgccatgcagactgaactgctgaaggcgctcaacgggcaggaatcgccgcaacaggccatcgcgaacatgaataccgtcggcaatcaatacctgagcggcgagcgcaggagctga

SEQ ID NO: 389 - DNA, 1380 bp, Artificial
  Substituion in SEQ ID NO 376
atggtcttgacccaatattcggccattcaaagggggagaattcacgtgagacgaagctgggttctcggcaccgcatccgccgtgatcttggcgggcgcgggaaccggtgtggcactcgatcgcgggcacgcgcacgacgcggttcgcgtggcgcctgcggaagcggcgagcgcaaacggagtcgttcagatcacattttggaacgggcatccttctggcgcgctgaagaaggagatgcacacccttgtcgacgagttcaacgccacccatcctcacatccatgtcacggttatcgacaagtacgcgcagattcagcccgtcaccgccgcaatgaccgctggcgatgcgccgaacgtgatcatgcctcacctcgatgccgctcagcagttcgcggcagacggctacctcgtgaacctgacgccgtacatcgacggaccgagcggtttcacgaaggctcaactctcctcgttcttctatccctctgtctggaacggccgcgccatcgagccgggcaaacaatacatcctcccgttcgaagaaaacgggcatatggtaatcttctacaacgcggatctgttcaagaaggcgggcatctcgtcgccgcccaagacgtggcagcagctcagggcggatgcgcggaagatcacggcgctcggcggaagcatccacggcattgcatggaccccctccatggagcaattcctgacgatggtcgcagacaacagcggaaagatttgggcatccagcagcgagacgcggttcgccctgaacaacccgcaggccgtcgccaccctctcctttttgcgcgatctcgtcgcgcagggcgacatgatcctcacccaaaactacgactatcaattggattttggcacgggcaacatcggtttgctcatcgaatcgtccgcagggtggacctatgacgtgcagtcggtcggcggcaagttcccggtcaaagcgtccccggcgcccgctggcacgtccggccgcgcgtacaactacgtcgacggcgacagcctcgccattttgaacacgggaaccaaggcgcagcaggatgcggcgtggacgttcattcgctggctcgcgagccccgcggaaaacgcgcagtgggatcaggcggcgaattaccttcccatcggacccgctgcagcagcccagctgaaaccgtactatgcttcccatcccgaccaggcggccgccttcacgaatccatccacatggctgacggatccggccgcgaacgcgacgcaatactacgccgcgctgaccgccatgcagactgaactgctgaaggcgctcaacgggcaggaatcgccgcaacaggccatcgcgaacatgaataccgtcggcaatcaatacctgagcggcgatcgcaggagctga

SEQ ID NO: 390 - DNA, 1380 bp, Artificial
  Substituion in SEQ ID NO 376
atggtcttgacccaatattcggccattcaaagggggagaattcacgtgagacgaagctgggttctcggcaccgcatccgccgtgatcttggcgggcgcgggaaccggtgtggcactcgatcgcgggcacgcgcacgacgcggttcgcgtggcgcctgcggaagcggcgagcgcaaacggagtcgttcagatcacattttggaacgggcatccttctggcgcgctgaagaaggagatgcacacccttgtcgacgagttcaacgccacccatcctcacatccatgtcacggttatcgacaagtacgcgcagattcagcccgtcaccgccgcaatgaccgctggcgatgcgccgaacgtgatcatgcctcacctcgatgccgctcagcagttcgcggcagacggctacctcgtgaacctgacgccgtacatcgacggaccgagcggtttcacgaaggctcaactctcctcgttcttctatccctctgtctggaacggccgcgccatcgagccgggcaaacaatacatcctcccgttcgaagaaaacgggcatatggtaatcttctacaacgcggatctgttcaagaaggcgggcatctcgtcgccgcccaagacgtggcagcagctcagggcggatgcgcggaagatcacggcgctcggcggaagcatccacggcattgcatggaccccctccatggagcaattcctgacgatggtcgcagacaacagcggaaagatttgggcatccagcagcgagacgcggttcgccctgaacaacccgcaggccgtcgccaccctctcctttttgcgcgatctcgtcgcgcagggcgacatgatcctcacccaaaactacgactatcaattggattttggcacgggcaacatcggtttgctcatcgaatcgtccgcagggtggacctatgacgtgcagtcggtcggcggcaagttcccggtcaaagcgtccccggcgcccgctggcacgtccggccgcgcgtacaactacgtcgacggcgacagcctcgccattattaacacgggaaccaaggcgcagcaggatgcggcgtggacgttcattcgctggctcgcgagccccgcggaaaacgcgcagtgggatcaggcggcgaattaccttcccatcggacccgctgcagcagcccagctgaaaccgtactatgcttcccatcccgaccaggcggccgccttcacgaatccatccacatggctgacggatccggccgcgaacgcgacgcaatactacgccgcgctgaccgccatgcagactgaactgctgaaggcgctcaacgggcaggaatcgccgcaacaggccatcgcgaacatgaataccgtcggcaatcaatacctgagcggcgagcgcaggagctga

SEQ ID NO: 391 - DNA, 1380 bp, Artificial
  Substituion in SEQ ID NO 376
atggtcttgacccaatattcggccattcaaagggggagaattcacgtgagacgaagctgggttctcggcaccgcatccgccgtgatcttggcgggcgcgggaaccggtgtggcaattgatcgcgggcacgcgcacgacgcggttcgcgtggcgcctgcggaagcggcgagcgcaaacggagtcgttcagatcacattttggaacgggcatccttctggcgcgctgaagaaggagatgcacacccttgtcgacgagttcaacgccacccatcctcacatccatgtcacggttatcgacaagtacgcgcagattcagcccgtcaccgccgcaatgaccgctggcgatgcgccgaacgtgatcatgcctcacctcgatgccgctcagcagttcgcggcagacggctacctcgtgaacctgacgccgtacatcgacggaccgagcggtttcacgaaggctcaactctcctcgttcttctatccctctgtctggaacggccgcgccatcgagccgggcaaacaatacatcctcccgttcgaagaaaacgggcatatggtaatcttctacaacgcggatctgttcaagaaggcgggcatctcgtcgccgcccaagacgtggcagcagctcagggcggatgcgcggaagatcacggcgctcggcggaagcatccacggcattgcatggaccccctccatggagcaattcctgacgatggtcgcagacaacagcggaaagatttgggcatccagcagcgagacgcggttcgccctgaacaacccgcaggccgtcgccaccctctcctttttgcgcgatctcgtcgcgcagggcgacatgatcctcacccaaaactacgactatcaattggattttggcacgggcaacatcggtttgctcatcgaatcgtccgcagggtggacctatgacgtgcagtcggtcggcggcaagttcccggtcaaagcgtccccggcgcccgctggcacgtccggccgcgcgtacaactacgtcgacggcgacagcctcgccattttgaacacgggaaccaaggcgcagcaggatgcggcgtggacgttcattcgctggctcgcgagccccgcggaaaacgcgcagtgggatcaggcggcgaattaccttcccatcggacccgctgcagcagcccagctgaaaccgtactatgcttcccatcccgaccaggcggccgccttcacgaatccatccacatggctgacggatccggccgcgaacgcgacgcaatactacgccgcgctgaccgccatgcagactgaactgctgaaggcgctcaacgggcaggaatcgccgcaacaggccatcgcgaacatgaataccgtcggcaatcaatacctgagcggcgagcgcaggagctga

SEQ ID NO: 392 - protein, 289 aa, Alicyclobacillus acidocaldarius
MRGLWQSGRRREGLRLMRRILTILAAYFVLAVGAFISIFPYLWAVLTSLKPESEVFTSHFLSLPTHIEWANYTHVFQQINMGRYLLNTVIVAVASVLGQLIFGSMAAYGFSRFNFKGKNVIFMLYLSTLMIPNIVTLIPLFIMMKYLGWINTYYALIAPAALGTPVGIFLLRQFFLTIPSEIEEAARMDGAGVIRVFVQIILPLSKPVLATLAIITFVSSWNNFLWPLIVTNTDSMKLVSVGIASFQFQVGAEWNYMMAASTIALLPLVILFLLFQRRIIESIQLTGLK

SEQ ID NO: 393 - DNA, 870 bp, Alicyclobacillus acidocaldarius
ttgcggggcttgtggcagtctggccgccggagggagggacttcggcttatgaggcgaattcttacgattcttgctgcttacttcgtcctcgctgtaggtgcattcatatccatatttccgtatctgtgggccgtacttacttctttgaagcctgaaagcgaggtcttcacatctcactttttgagtctgccgactcacatcgaatgggccaactatacccatgtatttcaacagattaacatggggcgatacttactgaacaccgtgattgtggcagttgcgagcgtgctaggccagctcattttcggttctatggctgcctatggattttcgcggtttaactttaaggggaagaatgtaatattcatgctttatttaagtacgctcatgatccccaacatcgtaacactcattcctctatttatcatgatgaaatatctggggtggatcaacacctactatgcactcattgcgccagctgcgctcgggactccggtgggcatatttctgttgagacaatttttcctaactattccctctgagattgaagaagccgctcgaatggacggagcaggtgtcattcgagtattcgtacaaatcatcttgcctttaagcaaaccggttctagcgactttggcaatcattacgttcgtgtcgtcatggaacaactttctatggcccctcattgtgacgaataccgactctatgaagcttgtgagtgtaggcattgcctcgtttcaatttcaagtaggtgcagaatggaactacatgatggctgcttccacaatagccctgctcccattggtcatcctattcttgctgtttcagcgcaggattatcgagtcaattcagctcactgggttgaagtag

SEQ ID NO: 394 - protein, 265 aa, Deinococcus geothermalis DSM 11300
LLLTHGVLLFGAFLAAMPFLWVITTSLKPNGALYQPPLLLPTHFEWENYRKAWEAAPFPRFFLNSAVMTVALTVSQTLLSAMAGYAFARLRFPGRNLLFFIVLGTLMIPFPVTLIPNFLTVNALGWVDTYQALIIPRAVSAFAIFLFRQFFLSIPKELEEAARIDGASPFTIFWRIVLPLSTPVLAASAIFSFLFAWNDFLWPLIITNSTEMRTVQVGLATFQGQYGIFWTLLCAATVIVTLPALLAFLAAQRRFIEGITSTGLK

SEQ ID NO: 395 - protein, 262 aa, Halothermothrix orenii H 168
YFILLFFLVITLYPFIWMVLTSFKIESDIVSYPPTLIPRTFTLKSYLNIWKSIPFVRFFINTVIFAVGVTVISVFFDSMAAYAFARINFPGKKFLFILVLATLMVPFQVTLIPVFKILFNLGWLDTFLALIIPRASNAFGIFLLRQFFITIPGELEDAARIDGCSEFRIYWNIILPLSKPALTTLAIFHFMYNWNDFLWPLVMTSSSTMRTLPVGLALFMGEHVIEYGLLMAGATLALLPIVVAYLFAQRFFIKGIALTGLK

SEQ ID NO: 396 - protein, 258 aa, Sinorhizobium medicae WSM419
VAAILALMTVFPLLWMVSIAFKGAQESFSPALLPSAPTWSNFVYVLTEVPFIRYMLNSLFVSVTVTVVALFFHSMAGYALARLRFPGRELIFLAIFSTLLVSLPVVIVPLFIIVRAMGMLNTYGGIIIPSIFNAFGIFLLRQYYLSLPREIEEAAVMDGAGYWRIYWSVILPLSKPILSALAILFFLANWNAFLWPLTVASDQKFWVVQVGIANFKSEYSAAWNYMLAASTIVAIPTLVLFLVFQRQIMDSIKTSGLK

SEQ ID NO: 397 - protein, 258 aa, Sinorhizobium meliloti 1021
VTAILAFMTLFPLLWIVSIAFKPAAESFSSNLIPQAPTLDNFIYVLTGVPFIRYMVNSFLVSATVTVVALFFHTMAGYALARLRFPGREVMFLSIFSTFLVSLPVIIVPLFVIVKAMGMLNSYAGLIIPAIFNAFGIFLLRQYYLSLPKEIEEAARIDGAGYWRIYWSVILPLSRPIMSALAILFFLANWNSFLWPLTITSDPDLWVVQLGIANFKSQYSASWNYMMAASTIVAIPTLILFVIFQRQIMDSLKTSGLK

SEQ ID NO: 398 - protein, 265 aa, Listeria monocytogenes EGD-e
ILTYTIICLGGIIMLMPFVWMVSTAFKTGAANMVLPPQFIPKEPTTANFTQVFEMFPMLRFLVNSVIVAVVTTLGQMLFCSMAAYAFARIPFWGRDKLFLLYLATMMVPAQVTMIPQFILMKQFGWLDSYAGLIVPALFSVFGTFLLRQAFMGIPKELEEAAFMDGANHFTIFRKVILPLAKPTFATLGILTFMQSWNSYLWPLIVTSSQEMATLPLGLSLLQGRYGTNYGLMMAGVLISVIPILAVYLFAQKYFIQGMAMSGMK

SEQ ID NO: 399 - protein, 289 aa, Artificial
  Substituion in SEQ ID NO 392
MRGLWQSGRRREGLRLMRRILTILAAYFVLAVGAFISIFPYLWAVLTSLKPESEVFTSHFLSLPTHIEWANYTHVFQQINMGRYLLNTVIVAVASVLGQLIFGSMAAYGFSRFNFKGKNVIFMLYLSTLMIPNIVTLIPLFIMMKYLGWINTYYALIAPAALGTPVGIFLLRQFFLTIPSEIEEAARMDGAGVIRVFVQIILPLSKPVLATLAIITFVSSWNNFLWPLIVTNTDSMKLVSIGIASFQFQVGAEWNYMMAASTIALLPLVILFLLFQRRIIESIQLTGLK

SEQ ID NO: 400 - protein, 289 aa, Artificial
  Substituion in SEQ ID NO 392
MRGLWQSGRRREGLRLMRRILTILAAYFVLAVGAFISIFPYLWAVLTSLKPESEVFTSHFLSLPTHIEWANYTHVFQQINMGRYLLNTVIVAVASVLGQLIFGSMAAYGFSRFNFKGKNVIFMLYLSTLMIPNIVTLLPLFIMMKYLGWINTYYALIAPAALGTPVGIFLLRQFFLTIPSEIEEAARMDGAGVIRVFVQIILPLSKPVLATLAIITFVSSWNNFLWPLIVTNTDSMKLVSVGIASFQFQVGAEWNYMMAASTIALLPLVILFLLFQRRIIESIQLTGLK

SEQ ID NO: 401 - protein, 289 aa, Artificial
  Substituion in SEQ ID NO 392
MRGLWQSGRRREGLRLMRRILTILAAYFVLAVGAFISIFPYLWAVLTSLKPESEVFTSHFLSLPTHIEWANYTHVFQQINMGRYLLNTVIVAVASVLGQLIFGSMAAYGFSRFNFKGKNVIFMLYLSTLMIPNIVTLIPLFIMMKYLGWINTYYALIAPAALGTPVGIFLLRQFFLTIPSEIEEAARMDGAGVIRVFVQIILPLSKPVLATLAIITFVSSWNNFLWPLIITNTDSMKLVSVGIASFQFQVGAEWNYMMAASTIALLPLVILFLLFQRRIIESIQLTGLK

SEQ ID NO: 402 - protein, 289 aa, Artificial
  Substituion in SEQ ID NO 392
MRGLWQSGRRREGLRLMRRILTILAAYFVLAVGAFISIFPYLWAVLTSLKPESEVFTSHFLSLPTHIEWANYTHVFQQINMGRYLLNTVIVAVASVLGQLIFGSMAAYGFSRFNFKGRNVIFMLYLSTLMIPNIVTLIPLFIMMKYLGWINTYYALIAPAALGTPVGIFLLRQFFLTIPSEIEEAARMDGAGVIRVFVQIILPLSKPVLATLAIITFVSSWNNFLWPLIVTNTDSMKLVSVGIASFQFQVGAEWNYMMAASTIALLPLVILFLLFQRRIIESIQLTGLK

SEQ ID NO: 403 - protein, 289 aa, Artificial
  Substituion in SEQ ID NO 392
MRGLWQSGRRREGLRLMRRILTILAAYFVLAVGAFISIFPYLWAVLTSLKPESEVFTSHFLSLPTHIEWANYTHVFQQINMGRYLLNTVIVAVASVIGQLIFGSMAAYGFSRFNFKGKNVIFMLYLSTLMIPNIVTLIPLFIMMKYLGWINTYYALIAPAALGTPVGIFLLRQFFLTIPSEIEEAARMDGAGVIRVFVQIILPLSKPVLATLAIITFVSSWNNFLWPLIVTNTDSMKLVSVGIASFQFQVGAEWNYMMAASTIALLPLVILFLLFQRRIIESIQLTGLK

SEQ ID NO: 404 - DNA, 870 bp, Artificial
  Substituion in SEQ ID NO 393
ttgcggggcttgtggcagtctggccgccggagggagggacttcggcttatgaggcgaattcttacgattcttgctgcttacttcgtcctcgctgtaggtgcattcatatccatatttccgtatctgtgggccgtacttacttctttgaagcctgaaagcgaggtcttcacatctcactttttgagtctgccgactcacatcgaatgggccaactatacccatgtatttcaacagattaacatggggcgatacttactgaacaccgtgattgtggcagttgcgagcgtgctaggccagctcattttcggttctatggctgcctatggattttcgcggtttaactttaaggggaagaatgtaatattcatgctttatttaagtacgctcatgatccccaacatcgtaacactcattcctctatttatcatgatgaaatatctggggtggatcaacacctactatgcactcattgcgccagctgcgctcgggactccggtgggcatatttctgttgagacaatttttcctaactattccctctgagattgaagaagccgctcgaatggacggagcaggtgtcattcgagtattcgtacaaatcatcttgcctttaagcaaaccggttctagcgactttggcaatcattacgttcgtgtcgtcatggaacaactttctatggcccctcattgtgacgaataccgactctatgaagcttgtgagtattggcattgcctcgtttcaatttcaagtaggtgcagaatggaactacatgatggctgcttccacaatagccctgctcccattggtcatcctattcttgctgtttcagcgcaggattatcgagtcaattcagctcactgggttgaagtag

SEQ ID NO: 405 - DNA, 870 bp, Artificial
  Substituion in SEQ ID NO 393
ttgcggggcttgtggcagtctggccgccggagggagggacttcggcttatgaggcgaattcttacgattcttgctgcttacttcgtcctcgctgtaggtgcattcatatccatatttccgtatctgtgggccgtacttacttctttgaagcctgaaagcgaggtcttcacatctcactttttgagtctgccgactcacatcgaatgggccaactatacccatgtatttcaacagattaacatggggcgatacttactgaacaccgtgattgtggcagttgcgagcgtgctaggccagctcattttcggttctatggctgcctatggattttcgcggtttaactttaaggggaagaatgtaatattcatgctttatttaagtacgctcatgatccccaacatcgtaacactcttacctctatttatcatgatgaaatatctggggtggatcaacacctactatgcactcattgcgccagctgcgctcgggactccggtgggcatatttctgttgagacaatttttcctaactattccctctgagattgaagaagccgctcgaatggacggagcaggtgtcattcgagtattcgtacaaatcatcttgcctttaagcaaaccggttctagcgactttggcaatcattacgttcgtgtcgtcatggaacaactttctatggcccctcattgtgacgaataccgactctatgaagcttgtgagtgtaggcattgcctcgtttcaatttcaagtaggtgcagaatggaactacatgatggctgcttccacaatagccctgctcccattggtcatcctattcttgctgtttcagcgcaggattatcgagtcaattcagctcactgggttgaagtag

SEQ ID NO: 406 - DNA, 870 bp, Artificial
  Substituion in SEQ ID NO 393
ttgcggggcttgtggcagtctggccgccggagggagggacttcggcttatgaggcgaattcttacgattcttgctgcttacttcgtcctcgctgtaggtgcattcatatccatatttccgtatctgtgggccgtacttacttctttgaagcctgaaagcgaggtcttcacatctcactttttgagtctgccgactcacatcgaatgggccaactatacccatgtatttcaacagattaacatggggcgatacttactgaacaccgtgattgtggcagttgcgagcgtgctaggccagctcattttcggttctatggctgcctatggattttcgcggtttaactttaaggggaagaatgtaatattcatgctttatttaagtacgctcatgatccccaacatcgtaacactcattcctctatttatcatgatgaaatatctggggtggatcaacacctactatgcactcattgcgccagctgcgctcgggactccggtgggcatatttctgttgagacaatttttcctaactattccctctgagattgaagaagccgctcgaatggacggagcaggtgtcattcgagtattcgtacaaatcatcttgcctttaagcaaaccggttctagcgactttggcaatcattacgttcgtgtcgtcatggaacaactttctatggcccctcattattacgaataccgactctatgaagcttgtgagtgtaggcattgcctcgtttcaatttcaagtaggtgcagaatggaactacatgatggctgcttccacaatagccctgctcccattggtcatcctattcttgctgtttcagcgcaggattatcgagtcaattcagctcactgggttgaagtag

SEQ ID NO: 407 - DNA, 870 bp, Artificial
  Substituion in SEQ ID NO 393
ttgcggggcttgtggcagtctggccgccggagggagggacttcggcttatgaggcgaattcttacgattcttgctgcttacttcgtcctcgctgtaggtgcattcatatccatatttccgtatctgtgggccgtacttacttctttgaagcctgaaagcgaggtcttcacatctcactttttgagtctgccgactcacatcgaatgggccaactatacccatgtatttcaacagattaacatggggcgatacttactgaacaccgtgattgtggcagttgcgagcgtgctaggccagctcattttcggttctatggctgcctatggattttcgcggtttaactttaaggggcgtaatgtaatattcatgctttatttaagtacgctcatgatccccaacatcgtaacactcattcctctatttatcatgatgaaatatctggggtggatcaacacctactatgcactcattgcgccagctgcgctcgggactccggtgggcatatttctgttgagacaatttttcctaactattccctctgagattgaagaagccgctcgaatggacggagcaggtgtcattcgagtattcgtacaaatcatcttgcctttaagcaaaccggttctagcgactttggcaatcattacgttcgtgtcgtcatggaacaactttctatggcccctcattgtgacgaataccgactctatgaagcttgtgagtgtaggcattgcctcgtttcaatttcaagtaggtgcagaatggaactacatgatggctgcttccacaatagccctgctcccattggtcatcctattcttgctgtttcagcgcaggattatcgagtcaattcagctcactgggttgaagtag

SEQ ID NO: 408 - DNA, 870 bp, Artificial
  Substituion in SEQ ID NO 393
ttgcggggcttgtggcagtctggccgccggagggagggacttcggcttatgaggcgaattcttacgattcttgctgcttacttcgtcctcgctgtaggtgcattcatatccatatttccgtatctgtgggccgtacttacttctttgaagcctgaaagcgaggtcttcacatctcactttttgagtctgccgactcacatcgaatgggccaactatacccatgtatttcaacagattaacatggggcgatacttactgaacaccgtgattgtggcagttgcgagcgtgattggccagctcattttcggttctatggctgcctatggattttcgcggtttaactttaaggggaagaatgtaatattcatgctttatttaagtacgctcatgatccccaacatcgtaacactcattcctctatttatcatgatgaaatatctggggtggatcaacacctactatgcactcattgcgccagctgcgctcgggactccggtgggcatatttctgttgagacaatttttcctaactattccctctgagattgaagaagccgctcgaatggacggagcaggtgtcattcgagtattcgtacaaatcatcttgcctttaagcaaaccggttctagcgactttggcaatcattacgttcgtgtcgtcatggaacaactttctatggcccctcattgtgacgaataccgactctatgaagcttgtgagtgtaggcattgcctcgtttcaatttcaagtaggtgcagaatggaactacatgatggctgcttccacaatagccctgctcccattggtcatcctattcttgctgtttcagcgcaggattatcgagtcaattcagctcactgggttgaagtag

SEQ ID NO: 409 - protein, 460 aa, Alicyclobacillus acidocaldarius
MNRNGKKVVFTIPVVLTMLLVGCGTSTANKPGHQFSTSEGSASTQVVTLHYMLWDPNEEIGYKQSIAVFEKLHPNIKVVIEQYPWSQYWQKLETEMAAGTAPDVFWDHVTYFPTFVTNGQLLNLTPYIKSSHVDLREYYPNLLKQYEYNGNIYGLPKDWDTIAIFYNKKLFEKDHVPFPTNLTWNPRNGGTLVKVAEEMTVDKNGKHPGQPGFNPNQIVQYGFMSYNSNQSFYYNFLAEDGVKILDHNFGTQVLMDTPQAIQTMQNLIDMIYKYHVSPSGAEGANVVNSEGNAQQLFEEGKLAMYTDGDWVLTPVVKASNFPVGIAPLPVGPIGRVSVMNGLSDAIYAHTKYPKQAWELVQWLASPQSERILASGGYVWPGIKSLAPLFAQAWTKKGVDVTPFLEESRGKTISFPITVNWGQAENAIDKEFDLMWLGKVPPSQALQTAVQQADAALNGGQ

SEQ ID NO: 410 - DNA, 1383 bp, Alicyclobacillus acidocaldarius
atgaatcgtaatggaaagaaggttgtttttactattccggttgttctgacgatgctcctagttggatgtggtacatcaactgcgaataagcctggtcatcagttctcaacgagtgaaggcagtgcttctacccaagttgtcacgttacattacatgctctgggatccgaacgaggaaatcggttacaagcagtccatcgccgtctttgaaaagttacatccgaatatcaaagttgtcatcgaacagtacccgtggtctcagtattggcaaaaattagagactgaaatggcggcagggacagctcccgacgtgttttgggatcatgttacttatttccctacttttgttacgaacggtcaacttctcaatttgacgccttatattaagagttcccatgtcgatttgagagaatattatccgaacttgctgaagcagtacgagtacaacggaaatatttatggcctgccaaaggactgggacacgatagccatattttataacaagaagctgttcgaaaaggatcatgttccatttccaacaaacttgacttggaatcctagaaatggtggaacattggtcaaggttgctgaagaaatgaccgtagataagaacggaaaacacccgggccagccagggttcaatccgaaccaaatcgtacaatacggatttatgtcatataactcaaatcagtcattttattacaactttttggccgaagacggagtgaaaatcctagaccataacttcgggactcaggtgctaatggacaccccgcaggccattcagaccatgcagaatcttattgacatgatttacaagtaccatgtatcgccttctggagccgagggagctaacgttgtaaatagtgaaggaaatgctcagcaattatttgaagaaggtaagctggcgatgtacaccgatggcgattgggtcctgacacctgtcgtgaaggcaagcaatttccctgtcgggatagctccgctacctgtcgggccaataggtcgtgtgtctgtcatgaacggactgtcggacgccatctatgcgcatacgaagtacccaaagcaagcgtgggaactggttcagtggctggcgagtccgcaatctgagcggatcctcgcatcgggtggttacgtatggcctgggatcaagtcgttggcaccactgtttgcacaggcctggaccaagaaaggcgtcgatgtcacgccgttcctcgaagaatcgaggggtaagaccatatcgttccccatcactgtgaactgggggcaagctgagaacgcgatcgacaaagaattcgatttaatgtggctagggaaagtgcccccgtctcaggcgctccaaacagccgtgcagcaggcggatgcggcactgaatggcggtcagtga

SEQ ID NO: 411 - protein, 424 aa, Renibacterium salmoninarum ATCC 33209
TATACSPAADNGGTASGDKVTVSVRLWDEQVQKAYESSFKEFESQNPGIQVKTVLEPYTTYFNKLRTDVSAGNADDVFWISSSYFSPYADNGSLLPIGSEFDSAKSGWVPAAVSQYTRNDKLWGVPQLTDGGIGVYYNKDLVAKAGVSLDNLSWNPTDPAQDTFLKAAQKLTLDSAGRTADDPAFDANNIVQYGYNASQDLQAIYYNFIGQNGGAFQDGEKFVFASPQSAQAFQYIVDLINKYHVSPGAANSNDNGDFMRDQFIQGKISMFQSGTYNLANVTQGAKYPWAIAPMPTGPAGAVSVVNNIIAAGNAKTAHKDATTKVLQWLGSTEGAKFIGAEGAADPAVTGAQDAYSSYWKAKDVDVSVFAKAAEGKTIQAPVGTNYGAAVNAWKPIFSEIFLGRTPVVSGLQQAQDAANKAIAG

SEQ ID NO: 412 - protein, 420 aa, Arthrobacter sp. FB24
SGSSAESAKGELSYWLWDANQLPAYQQCADDFQKANPDIKVKITQRGWDDYWSTLTNGFVGGTAPDVFTNHLGRYGELAANKQLLPIDDAVKKDNVDLSAYNEGLADLWVGQDGKRYGLPKDWDTIGLFYNKAMLSKAGVSEEEMKNLTWNPQDGGTYEKIIAHLTVDKNGKRGDEAGFDKNNVDVYGLGLNGGGDSSGQTEWSYLTNTTGWSHTDKNPWGTHYNYDDPKFQSSIDWFAGLVDKGYMPKLETTVGAAMADTFAAGKSAINAHGSWMIGQYTGYKGVEVGIAPTPVGPEGKRASMFNGLADSIWAGTKKKDAAIKWVEYLASAPCQDVVASKAVVFPALKASSEKAAEAFKAKGVDVTAFTEHVKNGTTFLYPITDNTAKVKGIMEPAMDAVVSGKKPASSLTEANNQVND

SEQ ID NO: 413 - protein, 419 aa, Streptomyces coelicolor A3(2)
LVSCGSSDEAGDGRTTVDYWLWDDLQLPAYQECATAFEKANPDIAVRITQTAWNQYWQNLTTQLVSGEAPDVWTNQATYYPQFAAGNQLLDLQPYVERDGLDVSAYQAGLADTWVKDDKRYGLPKDWDTMAVVYNTDMLKRQGVDLAALNDLTWNPADGGTLEQVIARATVDSEGRNGLDPAFDKDHVEVYGFLPEWADGAQGQNGWGNFAAANGFEYLDKNPWGTHYKFDDPRLAETVSWFRHLIDKGYAPRLDQQSSVARTELLIAGKGAMSLAGSFTVSSFTGPKVKQDFGFAAMPVGPAGRKSALNGLADSVWAGTDHKEEAWKWVKYLASADCQDRVAAHGVVFPALKSSTEKALAAHEADGDDVRAFTDAVGTKGVTFQLPVTEHGTEISPLVQDAIQSAILGQEDAADALES

SEQ ID NO: 414 - protein, 398 aa, Mycobacterium avium subsp. paratuberculosis K-10
VWGDELAEAYRQSFAAFTRAHPDIEVHVNMVAYSTYFNTLRTDVAGGSADDIFWLSNAYLAAYADSGRLLNILDTLGTNAAADWERPVVEQFTRHGQLWGVPQLTDAGIALYYNADLLGAAGIDPAQLNGLRWDPAGGDTLRPLLARLTVDADGNRGDTRGFDPGRVRQWGYNAANDPQGIYLNYIGSAGGVFQRGDEFAFDNPAAVSAFRYLVDLINRDHVAPSAADTNDNGDFSRNQFLAGRMALFQSGTYNLAPVARDARFRWGVAMMPAGPVGRVSVTNGIAAAGNAATKHPAAVRQVLAWMGSRQGNEYLGRYGAAIPAVTSAQPVYFRYWASRGVDVTPFFAVLNGPRIAAPGGAGFAAGNDALRPYFDEMFSGRGDVATTLRRAQAAANAA

SEQ ID NO: 415 - protein, 398 aa, Mycobacterium avium 104
VWGDELAEAYRQSFAAFTRAHPDIEVHVNMVAYSTYFNTLRTDVAGGSADDIFWLSNAYLAAYADSGRLLNILDTLGTNAAADWERPVVEQFTRHGQLWGVPQLTDAGIALYYNADLLGAAGIDPAQLNSLRWNPAGGDTLRPLLARLTVDADGNRGDTRGFDPGRVRQWGYNAANDPQGIYLNYIGSAGGVFQRGDEFAFDNPAAVSAFRYLVDLINRDHVAPPAADTNDNGDFSRNQFLAGRMALFQSGTYNLAPVARDARFRWGVAMMPAGPVGRVSVTNGIAAAGNAATKHPGAVRQVLAWMGSRQGNEYLGRYGAAIPAVTSAQPVYFGYWAARGVDVTPFFAVLNGPRIAAPGGAGFAAGNDALRPYFDEMFSGRGDVATTLRRAQAAANAA

SEQ ID NO: 416 - protein, 460 aa, Artificial
  Substituion in SEQ ID NO 409
MNRNGKKVVFTIPVVLTMLLVGCGTSTANKPGHQFSTSEGSASTQVVTLHYMLWDPNEEIGYKQSIAVFEKLHPNIKVVIEQYPWSQYWQKLETEMAAGTAPDVFWDHVTYFPTFVTNGQLLNLTPYIKSSHVDIREYYPNLLKQYEYNGNIYGLPKDWDTIAIFYNKKLFEKDHVPFPTNLTWNPRNGGTLVKVAEEMTVDKNGKHPGQPGFNPNQIVQYGFMSYNSNQSFYYNFLAEDGVKILDHNFGTQVLMDTPQAIQTMQNLIDMIYKYHVSPSGAEGANVVNSEGNAQQLFEEGKLAMYTDGDWVLTPVVKASNFPVGIAPLPVGPIGRVSVMNGLSDAIYAHTKYPKQAWELVQWLASPQSERILASGGYVWPGIKSLAPLFAQAWTKKGVDVTPFLEESRGKTISFPITVNWGQAENAIDKEFDLMWLGKVPPSQALQTAVQQADAALNGGQ

SEQ ID NO: 417 - protein, 460 aa, Artificial
  Substituion in SEQ ID NO 409
MNRNGKKVVFTIPVVLTMLLVGCGTSTANKPGHQFSTSEGSASTQVVTLHYMLWDPNEEIGYKQSIAVFEKLHPNIKVVIEQYPWSQYWQKLETEMAAGTAPDVFWDHVTYFPTFVTNGQLLNLTPYIKSSHVDLREYYPNLLKQYEYNGNIYGLPKDWDTIAIFYNKKLFEKDHVPFPTNLTWNPRNGGTLVKVAEEMTVDKNGKHPGQPGFNPNQIVQYGFMSYNSNQSFYYNFLAEDGVKILDHNFGTQVLMDTPQAIQTMQNLIDMIYKYHVSPSGAEGANVVNSEGNAQQLFEEGKLAMYTDGDWVLTPVVKASNFPVGIAPLPVGPIGRVSVMNGLSDAIYAHTKYPKQAWELVQWLASPQSERILASGGYVWPGIKSLAPLFAQAWTKKGVDVTPFLEESRGKTLSFPITVNWGQAENAIDKEFDLMWLGKVPPSQALQTAVQQADAALNGGQ

SEQ ID NO: 418 - protein, 460 aa, Artificial
  Substituion in SEQ ID NO 409
MNRNGKKVVFTIPVVLTMLLVGCGTSTANKPGHQFSTSEGSASTQVVTLHYMLWDPNEEIGYKQSIAVFEKLHPNIKVVIEQYPWSQYWQKLETEMAAGTAPDVFWDHVTYFPTFVTNGQLLNLTPYIKSSHVDLREYYPNLLKQYEYNGNIYGLPKDWDTIAIFYNKKLFEKDHVPFPTNLTWNPRNGGTLVKVAEEMTVDKNGKHPGQPGFNPNQIVQYGFMSYNSNQSFYYNFLAEDGVKILDHNFGTQVLMDTPQAIQTMQNLIDMIYKYHVSPSGAEGANVVNSEGNAQQLFEEGKLAMYTDGDWVLTPIVKASNFPVGIAPLPVGPIGRVSVMNGLSDAIYAHTKYPKQAWELVQWLASPQSERILASGGYVWPGIKSLAPLFAQAWTKKGVDVTPFLEESRGKTISFPITVNWGQAENAIDKEFDLMWLGKVPPSQALQTAVQQADAALNGGQ

SEQ ID NO: 419 - protein, 460 aa, Artificial
  Substituion in SEQ ID NO 409
MNRNGKKVVFTIPVVLTMLLVGCGTSTANKPGHQFSTSEGSASTQVVTLHYMLWDPNEEIGYKQSIAVFEKLHPNIKVVIEQYPWSQYWQKLETEMAAGTAPDVFWDHVTYFPTFVTNGQLLNLTPYIKSSHVDLREYYPNLLKQYEYNGNIYGLPKDWDTIAIFYNKKLFEKDHVPFPTNLTWNPRNGGTLVKVAEEMTVDKNGKHPGQPGFNPNQIVQYGFMSYNSNQSFYYNFLAEDGVKILDHNFGTQVLMDTPQAIQTMQNLIDMIYRYHVSPSGAEGANVVNSEGNAQQLFEEGKLAMYTDGDWVLTPVVKASNFPVGIAPLPVGPIGRVSVMNGLSDAIYAHTKYPKQAWELVQWLASPQSERILASGGYVWPGIKSLAPLFAQAWTKKGVDVTPFLEESRGKTISFPITVNWGQAENAIDKEFDLMWLGKVPPSQALQTAVQQADAALNGGQ

SEQ ID NO: 420 - protein, 460 aa, Artificial
  Substituion in SEQ ID NO 409
MNRNGKKVVFTIPVVLTMLLVGCGTSTANKPGHQFSTSEGSASTQVVTLHYMLWDPNEEIGYKQSIAVFEKLHPNIKVVIEQYPWSQYWQKLETEMAAGTAPDVFWDHVTYFPTFVTNGQLLNLTPYIKSSHVDLREYYPNLLKQYEYNGNIYGLPKDWDTIAIFYNKKLFEKDHVPFPTNLTWNPRNGGTLVKVAEEMTVDKNGKHPGQPGFNPNQIVQYGFMSYNSNQSFYYNFLAEDGVKILDHNFGTQVLMDTPQAIQTMQNLIDMIYKYHVSPSGAEGANVVNSEGNAQQLFEEGKLAMYTDGDWVLTPVVKASNFPVGIAPLPVGPIGRVSVMNGLSDAIYAHTKYPKQAWELVQWLASPNSERILASGGYVWPGIKSLAPLFAQAWTKKGVDVTPFLEESRGKTISFPITVNWGQAENAIDKEFDLMWLGKVPPSQALQTAVQQADAALNGGQ

SEQ ID NO: 421 - DNA, 1383 bp, Artificial
  Substituion in SEQ ID NO 410
atgaatcgtaatggaaagaaggttgtttttactattccggttgttctgacgatgctcctagttggatgtggtacatcaactgcgaataagcctggtcatcagttctcaacgagtgaaggcagtgcttctacccaagttgtcacgttacattacatgctctgggatccgaacgaggaaatcggttacaagcagtccatcgccgtctttgaaaagttacatccgaatatcaaagttgtcatcgaacagtacccgtggtctcagtattggcaaaaattagagactgaaatggcggcagggacagctcccgacgtgttttgggatcatgttacttatttccctacttttgttacgaacggtcaacttctcaatttgacgccttatattaagagttcccatgtcgatattagagaatattatccgaacttgctgaagcagtacgagtacaacggaaatatttatggcctgccaaaggactgggacacgatagccatattttataacaagaagctgttcgaaaaggatcatgttccatttccaacaaacttgacttggaatcctagaaatggtggaacattggtcaaggttgctgaagaaatgaccgtagataagaacggaaaacacccgggccagccagggttcaatccgaaccaaatcgtacaatacggatttatgtcatataactcaaatcagtcattttattacaactttttggccgaagacggagtgaaaatcctagaccataacttcgggactcaggtgctaatggacaccccgcaggccattcagaccatgcagaatcttattgacatgatttacaagtaccatgtatcgccttctggagccgagggagctaacgttgtaaatagtgaaggaaatgctcagcaattatttgaagaaggtaagctggcgatgtacaccgatggcgattgggtcctgacacctgtcgtgaaggcaagcaatttccctgtcgggatagctccgctacctgtcgggccaataggtcgtgtgtctgtcatgaacggactgtcggacgccatctatgcgcatacgaagtacccaaagcaagcgtgggaactggttcagtggctggcgagtccgcaatctgagcggatcctcgcatcgggtggttacgtatggcctgggatcaagtcgttggcaccactgtttgcacaggcctggaccaagaaaggcgtcgatgtcacgccgttcctcgaagaatcgaggggtaagaccatatcgttccccatcactgtgaactgggggcaagctgagaacgcgatcgacaaagaattcgatttaatgtggctagggaaagtgcccccgtctcaggcgctccaaacagccgtgcagcaggcggatgcggcactgaatggcggtcagtga

SEQ ID NO: 422 - DNA, 1383 bp, Artificial
  Substituion in SEQ ID NO 410
atgaatcgtaatggaaagaaggttgtttttactattccggttgttctgacgatgctcctagttggatgtggtacatcaactgcgaataagcctggtcatcagttctcaacgagtgaaggcagtgcttctacccaagttgtcacgttacattacatgctctgggatccgaacgaggaaatcggttacaagcagtccatcgccgtctttgaaaagttacatccgaatatcaaagttgtcatcgaacagtacccgtggtctcagtattggcaaaaattagagactgaaatggcggcagggacagctcccgacgtgttttgggatcatgttacttatttccctacttttgttacgaacggtcaacttctcaatttgacgccttatattaagagttcccatgtcgatttgagagaatattatccgaacttgctgaagcagtacgagtacaacggaaatatttatggcctgccaaaggactgggacacgatagccatattttataacaagaagctgttcgaaaaggatcatgttccatttccaacaaacttgacttggaatcctagaaatggtggaacattggtcaaggttgctgaagaaatgaccgtagataagaacggaaaacacccgggccagccagggttcaatccgaaccaaatcgtacaatacggatttatgtcatataactcaaatcagtcattttattacaactttttggccgaagacggagtgaaaatcctagaccataacttcgggactcaggtgctaatggacaccccgcaggccattcagaccatgcagaatcttattgacatgatttacaagtaccatgtatcgccttctggagccgagggagctaacgttgtaaatagtgaaggaaatgctcagcaattatttgaagaaggtaagctggcgatgtacaccgatggcgattgggtcctgacacctgtcgtgaaggcaagcaatttccctgtcgggatagctccgctacctgtcgggccaataggtcgtgtgtctgtcatgaacggactgtcggacgccatctatgcgcatacgaagtacccaaagcaagcgtgggaactggttcagtggctggcgagtccgcaatctgagcggatcctcgcatcgggtggttacgtatggcctgggatcaagtcgttggcaccactgtttgcacaggcctggaccaagaaaggcgtcgatgtcacgccgttcctcgaagaatcgaggggtaagaccttatcgttccccatcactgtgaactgggggcaagctgagaacgcgatcgacaaagaattcgatttaatgtggctagggaaagtgcccccgtctcaggcgctccaaacagccgtgcagcaggcggatgcggcactgaatggcggtcagtga

SEQ ID NO: 423 - DNA, 1383 bp, Artificial
  Substituion in SEQ ID NO 410
atgaatcgtaatggaaagaaggttgtttttactattccggttgttctgacgatgctcctagttggatgtggtacatcaactgcgaataagcctggtcatcagttctcaacgagtgaaggcagtgcttctacccaagttgtcacgttacattacatgctctgggatccgaacgaggaaatcggttacaagcagtccatcgccgtctttgaaaagttacatccgaatatcaaagttgtcatcgaacagtacccgtggtctcagtattggcaaaaattagagactgaaatggcggcagggacagctcccgacgtgttttgggatcatgttacttatttccctacttttgttacgaacggtcaacttctcaatttgacgccttatattaagagttcccatgtcgatttgagagaatattatccgaacttgctgaagcagtacgagtacaacggaaatatttatggcctgccaaaggactgggacacgatagccatattttataacaagaagctgttcgaaaaggatcatgttccatttccaacaaacttgacttggaatcctagaaatggtggaacattggtcaaggttgctgaagaaatgaccgtagataagaacggaaaacacccgggccagccagggttcaatccgaaccaaatcgtacaatacggatttatgtcatataactcaaatcagtcattttattacaactttttggccgaagacggagtgaaaatcctagaccataacttcgggactcaggtgctaatggacaccccgcaggccattcagaccatgcagaatcttattgacatgatttacaagtaccatgtatcgccttctggagccgagggagctaacgttgtaaatagtgaaggaaatgctcagcaattatttgaagaaggtaagctggcgatgtacaccgatggcgattgggtcctgacacctattgtgaaggcaagcaatttccctgtcgggatagctccgctacctgtcgggccaataggtcgtgtgtctgtcatgaacggactgtcggacgccatctatgcgcatacgaagtacccaaagcaagcgtgggaactggttcagtggctggcgagtccgcaatctgagcggatcctcgcatcgggtggttacgtatggcctgggatcaagtcgttggcaccactgtttgcacaggcctggaccaagaaaggcgtcgatgtcacgccgttcctcgaagaatcgaggggtaagaccatatcgttccccatcactgtgaactgggggcaagctgagaacgcgatcgacaaagaattcgatttaatgtggctagggaaagtgcccccgtctcaggcgctccaaacagccgtgcagcaggcggatgcggcactgaatggcggtcagtga

SEQ ID NO: 424 - DNA, 1383 bp, Artificial
  Substituion in SEQ ID NO 410
atgaatcgtaatggaaagaaggttgtttttactattccggttgttctgacgatgctcctagttggatgtggtacatcaactgcgaataagcctggtcatcagttctcaacgagtgaaggcagtgcttctacccaagttgtcacgttacattacatgctctgggatccgaacgaggaaatcggttacaagcagtccatcgccgtctttgaaaagttacatccgaatatcaaagttgtcatcgaacagtacccgtggtctcagtattggcaaaaattagagactgaaatggcggcagggacagctcccgacgtgttttgggatcatgttacttatttccctacttttgttacgaacggtcaacttctcaatttgacgccttatattaagagttcccatgtcgatttgagagaatattatccgaacttgctgaagcagtacgagtacaacggaaatatttatggcctgccaaaggactgggacacgatagccatattttataacaagaagctgttcgaaaaggatcatgttccatttccaacaaacttgacttggaatcctagaaatggtggaacattggtcaaggttgctgaagaaatgaccgtagataagaacggaaaacacccgggccagccagggttcaatccgaaccaaatcgtacaatacggatttatgtcatataactcaaatcagtcattttattacaactttttggccgaagacggagtgaaaatcctagaccataacttcgggactcaggtgctaatggacaccccgcaggccattcagaccatgcagaatcttattgacatgatttaccgttaccatgtatcgccttctggagccgagggagctaacgttgtaaatagtgaaggaaatgctcagcaattatttgaagaaggtaagctggcgatgtacaccgatggcgattgggtcctgacacctgtcgtgaaggcaagcaatttccctgtcgggatagctccgctacctgtcgggccaataggtcgtgtgtctgtcatgaacggactgtcggacgccatctatgcgcatacgaagtacccaaagcaagcgtgggaactggttcagtggctggcgagtccgcaatctgagcggatcctcgcatcgggtggttacgtatggcctgggatcaagtcgttggcaccactgtttgcacaggcctggaccaagaaaggcgtcgatgtcacgccgttcctcgaagaatcgaggggtaagaccatatcgttccccatcactgtgaactgggggcaagctgagaacgcgatcgacaaagaattcgatttaatgtggctagggaaagtgcccccgtctcaggcgctccaaacagccgtgcagcaggcggatgcggcactgaatggcggtcagtga

SEQ ID NO: 425 - DNA, 1383 bp, Artificial
  Substituion in SEQ ID NO 410
atgaatcgtaatggaaagaaggttgtttttactattccggttgttctgacgatgctcctagttggatgtggtacatcaactgcgaataagcctggtcatcagttctcaacgagtgaaggcagtgcttctacccaagttgtcacgttacattacatgctctgggatccgaacgaggaaatcggttacaagcagtccatcgccgtctttgaaaagttacatccgaatatcaaagttgtcatcgaacagtacccgtggtctcagtattggcaaaaattagagactgaaatggcggcagggacagctcccgacgtgttttgggatcatgttacttatttccctacttttgttacgaacggtcaacttctcaatttgacgccttatattaagagttcccatgtcgatttgagagaatattatccgaacttgctgaagcagtacgagtacaacggaaatatttatggcctgccaaaggactgggacacgatagccatattttataacaagaagctgttcgaaaaggatcatgttccatttccaacaaacttgacttggaatcctagaaatggtggaacattggtcaaggttgctgaagaaatgaccgtagataagaacggaaaacacccgggccagccagggttcaatccgaaccaaatcgtacaatacggatttatgtcatataactcaaatcagtcattttattacaactttttggccgaagacggagtgaaaatcctagaccataacttcgggactcaggtgctaatggacaccccgcaggccattcagaccatgcagaatcttattgacatgatttacaagtaccatgtatcgccttctggagccgagggagctaacgttgtaaatagtgaaggaaatgctcagcaattatttgaagaaggtaagctggcgatgtacaccgatggcgattgggtcctgacacctgtcgtgaaggcaagcaatttccctgtcgggatagctccgctacctgtcgggccaataggtcgtgtgtctgtcatgaacggactgtcggacgccatctatgcgcatacgaagtacccaaagcaagcgtgggaactggttcagtggctggcgagtccgaattctgagcggatcctcgcatcgggtggttacgtatggcctgggatcaagtcgttggcaccactgtttgcacaggcctggaccaagaaaggcgtcgatgtcacgccgttcctcgaagaatcgaggggtaagaccatatcgttccccatcactgtgaactgggggcaagctgagaacgcgatcgacaaagaattcgatttaatgtggctagggaaagtgcccccgtctcaggcgctccaaacagccgtgcagcaggcggatgcggcactgaatggcggtcagtga

SEQ ID NO: 426 - protein, 312 aa, Alicyclobacillus acidocaldarius
MRIMGIDASARLTRQVETNASYNIGRRLAPYAFIFPSFIGVLAFLLVPAVAVLIISLFNWNMLSPPKFVGLRNYLDIFQDPLALHSMLVTVYYVLLNIPVQTVLAILLALLLNRRLPGMGMFRAFFVLPWLAMPVAISVVWNLIFDPTNGVLNDVLTAVGLHPQQWLSSPVEALPCVAAVNIWQWTGYNMLFFLAGLQSIPSHLYEAANIDGAGRLRKFFSITLPLLRPTLLFVLITSVIGSFQVFDTVYVMTQGGPGTATNVYNYYIFQQGFQFFHMGYAAALSVILFVVILLVTLIQFRFVGKGATYDMS

SEQ ID NO: 427 - DNA, 939 bp, Alicyclobacillus acidocaldarius
gtgagaattatggggatcgacgccagcgctcggctgactcggcaagtagaaacaaatgcttcatacaacatcggcaggcgactggctccttacgcctttatattcccgagtttcataggagtattggcgtttcttcttgtacctgctgtcgcagtgctgattataagcctcttcaattggaatatgttatcaccccctaaatttgttgggcttcgtaactatcttgacatctttcaagatccccttgcactccactccatgcttgtgacagtgtattatgttttgctcaatattccggtccaaactgtgttggccattttgcttgcgcttttgttgaaccgcagacttccgggaatggggatgtttcgagcgttctttgtccttccttggctggccatgccggtagctatctcagtggtgtggaacttgatctttgatccaaccaatggcgttctcaatgacgtgttaactgccgttggcctgcacccgcagcagtggctttcatcgccagtagaagccctgccttgcgttgctgcagtaaacatatggcaatggaccgggtataacatgctctttttccttgcggggctacaaagtatcccgtcccatctttatgaagcagcgaatatcgatggggcggggcgactgcgaaagttcttttcaatcaccttgccactgctcaggccgacactgttgttcgtgctgatcacgagtgtgatcggctcctttcaagtgttcgacactgtctatgtgatgacacaaggaggtcccggtacagcgacgaacgtttacaactactatatattccagcagggatttcagttttttcacatgggctatgctgcggcgttgtcagtcattctgtttgtcgtgattctcttggttacacttatccaattccgttttgtgggcaaaggagcaacatacgacatgagttga

SEQ ID NO: 428 - protein, 257 aa, Reinekea sp. MED297
NIRSSLIGFGLIFPALVGFSLFYAWPAIRAIAISFTDWNLLSEPTFVGFDNYIEMVQDGQFWNGMKLSAYYVLLNIPLQVVLGLFLAVAMDRLTRSLFVKATVLLPYLLSNVLVAMVWLWMLDPILGIVNFFLDAIGIGRQSFLGDPEQALISVAAINIWRHMGLCAMLFLAGLQTIPRYLYEAASLEGASEWKMFRMITLPLLRPVMVFVLVTSVTGSFQIFDTIAVTTMGGPMDSTRVIVYYIIQNAFSFYKMGY

SEQ ID NO: 429 - protein, 249 aa, Enterococcus faecalis V583
SFIAPNFIGFFLFTLIPVICSLILAFMSWDSFSTPEFVGMKNFTKMIHDDTFWISLKQTFIYTIGVVPLTLICSLGLAILLNRKIRGMKFFRTAFFFPYVTSLVAIAVVWNMLFHPTMGPINQFLKLFIENPPGWTSSSTWALPAIIIVSVWRFMGYYMILYLAGLQSVPRELYEAASMDGAGKWNQFLNVTLPSLRPTTFFVTIMLVINCFKVFDLVQVMTGGGPGRATNVLVYEIYNEAFVKFNFGY

SEQ ID NO: 430 - protein, 285 aa, Bacillus clausii KSM-K16
KTLAFYLFISPWLIGFLALAAGPMIYSFYMSFTEWQVMGGAEWIGLENYERLFFHDPLFWKTMWNTFFYTFLGVPLGLAFGYLLAVLLNQKVKFMGVFRTIFYLPSIVPAVASSLLWVLIFQPEFGLANALLDSVGLPTSRWLLSESMVKPALIIMSLWGVGGGMIIYLAGLQGVPPSLYEAAEIDGAGKWRKFWHITIPMTSHVIFFNLIMGVIGSFQVFTQAYVMSGGGPNYASLFYVLYLYQNAFEFFNMGYASALAWVLFVIVLIFTLLQFKFFGKKVYYE

SEQ ID NO: 431 - protein, 253 aa, Streptomyces coelicolor A3(2)
RKAAWLFLAPALLGFALFYAYPTVRGIYYSLTDYSLIATPDFVGGDNYSRLIGDEQFWNALQVTGYYVLVNIVSQTLLALVLATLMHRLTRSVALRAMLLVPWLVPNVTVGLLWMWLLDTNLGLVNHVLNSMGMGTTGFFTSPDWAMPSVAAVNTWAYTGYTALLLYAGMLQVPQYLYESASLDGAGEWRMFTRITLPLLRPVLSLVLVVSLIGSFQIFDTIAVTTKGGPVSATRVIYYYIYEQAFTNFHMGY

SEQ ID NO: 432 - protein, 244 aa, Mycobacterium tuberculosis CDC1551
RTALAYALLAPSLVGVVAFLLLPILVVVWLSLHRWDLLGPLRYVGLTNWRSVLTDSGFADSLVVTAVFVAIVVPAQTVLGLLAASLLARRLPGTGLFRTLYVLPWICAPLAIAVMWRWILAPTDGAISTVLGHRIEWLTDPGLALPVVSAVVVWTNVGYVSLFFLAGLMAIPQDIHNAARTDGASAWQRFWRITLPMLRPTMFFVLVTGIISAAQVFDTVYALTGGGPQGSTDLVAHRIYAEAF

SEQ ID NO: 433 - protein, 312 aa, Artificial
  Substituion in SEQ ID NO 426
MRIMGIDASARLTRQVETNASYNIGRRLAPYAFIFPSFIGVLAFLLVPAVAVLIISLFNWNMLSPPKFVGLRNYLDIFQDPLALHSMLVTVYYVLLNIPVQTVLAILLALLLNRRLPGMGMFRAFFVLPWLAMPVAISVVWNLIFDPTNGVLNDVLTAVGLHPQQWLSSPVEALPCVAAVNIWQWTGYNMLFFLAGLNSIPSHLYEAANIDGAGRLRKFFSITLPLLRPTLLFVLITSVIGSFQVFDTVYVMTQGGPGTATNVYNYYIFQQGFQFFHMGYAAALSVILFVVILLVTLIQFRFVGKGATYDMS

SEQ ID NO: 434 - protein, 312 aa, Artificial
  Substituion in SEQ ID NO 426
MRIMGIDASARLTRQVETNASYNIGRRLAPYAFIFPSFIGVLAFLLVPAVAVLIISLFNWNMLSPPKFVGLRNYLDIFQDPLALHSMLVTVYYVLLNIPVQTVLAILLALLLNRRLPGMGMFRAFFVLPWLAMPVAISVVWNLIFDPTNGVLNDVLTAVGLHPQQWLSSPVEAIPCVAAVNIWQWTGYNMLFFLAGLQSIPSHLYEAANIDGAGRLRKFFSITLPLLRPTLLFVLITSVIGSFQVFDTVYVMTQGGPGTATNVYNYYIFQQGFQFFHMGYAAALSVILFVVILLVTLIQFRFVGKGATYDMS

SEQ ID NO: 435 - protein, 312 aa, Artificial
  Substituion in SEQ ID NO 426
MRIMGIDASARLTRQVETNASYNIGRRLAPYAFIFPSFIGVLAFLLVPAVAVLLISLFNWNMLSPPKFVGLRNYLDIFQDPLALHSMLVTVYYVLLNIPVQTVLAILLALLLNRRLPGMGMFRAFFVLPWLAMPVAISVVWNLIFDPTNGVLNDVLTAVGLHPQQWLSSPVEALPCVAAVNIWQWTGYNMLFFLAGLQSIPSHLYEAANIDGAGRLRKFFSITLPLLRPTLLFVLITSVIGSFQVFDTVYVMTQGGPGTATNVYNYYIFQQGFQFFHMGYAAALSVILFVVILLVTLIQFRFVGKGATYDMS

SEQ ID NO: 436 - protein, 312 aa, Artificial
  Substituion in SEQ ID NO 426
MRIMGIDASARLTRQVETNASYNIGRRLAPYAFIFPSFIGVLAFLLVPAVAVLIISLFNWNMLSPPKFVGLRNYLDIFQDPLALHSMLVTVYYVLLNIPVQTVLAILLALLLNRRLPGMGMFRAFFVLPWLAMPVAISVVWNLIFDPTNGVLNDVLTAVGLHPQQWLSSPVEALPCVAAVNIWQWTGYNMLFFIAGLQSIPSHLYEAANIDGAGRLRKFFSITLPLLRPTLLFVLITSVIGSFQVFDTVYVMTQGGPGTATNVYNYYIFQQGFQFFHMGYAAALSVILFVVILLVTLIQFRFVGKGATYDMS

SEQ ID NO: 437 - protein, 312 aa, Artificial
  Substituion in SEQ ID NO 426
MRIMGIDASARLTRQVETNASYNIGRRLAPYAFIFPSFIGVLAFLLVPAVAVLIISLFNWNMISPPKFVGLRNYLDIFQDPLALHSMLVTVYYVLLNIPVQTVLAILLALLLNRRLPGMGMFRAFFVLPWLAMPVAISVVWNLIFDPTNGVLNDVLTAVGLHPQQWLSSPVEALPCVAAVNIWQWTGYNMLFFLAGLQSIPSHLYEAANIDGAGRLRKFFSITLPLLRPTLLFVLITSVIGSFQVFDTVYVMTQGGPGTATNVYNYYIFQQGFQFFHMGYAAALSVILFVVILLVTLIQFRFVGKGATYDMS

SEQ ID NO: 438 - DNA, 939 bp, Artificial
  Substituion in SEQ ID NO 427
gtgagaattatggggatcgacgccagcgctcggctgactcggcaagtagaaacaaatgcttcatacaacatcggcaggcgactggctccttacgcctttatattcccgagtttcataggagtattggcgtttcttcttgtacctgctgtcgcagtgctgattataagcctcttcaattggaatatgttatcaccccctaaatttgttgggcttcgtaactatcttgacatctttcaagatccccttgcactccactccatgcttgtgacagtgtattatgttttgctcaatattccggtccaaactgtgttggccattttgcttgcgcttttgttgaaccgcagacttccgggaatggggatgtttcgagcgttctttgtccttccttggctggccatgccggtagctatctcagtggtgtggaacttgatctttgatccaaccaatggcgttctcaatgacgtgttaactgccgttggcctgcacccgcagcagtggctttcatcgccagtagaagccctgccttgcgttgctgcagtaaacatatggcaatggaccgggtataacatgctctttttccttgcggggctaaatagtatcccgtcccatctttatgaagcagcgaatatcgatggggcggggcgactgcgaaagttcttttcaatcaccttgccactgctcaggccgacactgttgttcgtgctgatcacgagtgtgatcggctcctttcaagtgttcgacactgtctatgtgatgacacaaggaggtcccggtacagcgacgaacgtttacaactactatatattccagcagggatttcagttttttcacatgggctatgctgcggcgttgtcagtcattctgtttgtcgtgattctcttggttacacttatccaattccgttttgtgggcaaaggagcaacatacgacatgagttga

SEQ ID NO: 439 - DNA, 939 bp, Artificial
  Substituion in SEQ ID NO 427
gtgagaattatggggatcgacgccagcgctcggctgactcggcaagtagaaacaaatgcttcatacaacatcggcaggcgactggctccttacgcctttatattcccgagtttcataggagtattggcgtttcttcttgtacctgctgtcgcagtgctgattataagcctcttcaattggaatatgttatcaccccctaaatttgttgggcttcgtaactatcttgacatctttcaagatccccttgcactccactccatgcttgtgacagtgtattatgttttgctcaatattccggtccaaactgtgttggccattttgcttgcgcttttgttgaaccgcagacttccgggaatggggatgtttcgagcgttctttgtccttccttggctggccatgccggtagctatctcagtggtgtggaacttgatctttgatccaaccaatggcgttctcaatgacgtgttaactgccgttggcctgcacccgcagcagtggctttcatcgccagtagaagccattccttgcgttgctgcagtaaacatatggcaatggaccgggtataacatgctctttttccttgcggggctacaaagtatcccgtcccatctttatgaagcagcgaatatcgatggggcggggcgactgcgaaagttcttttcaatcaccttgccactgctcaggccgacactgttgttcgtgctgatcacgagtgtgatcggctcctttcaagtgttcgacactgtctatgtgatgacacaaggaggtcccggtacagcgacgaacgtttacaactactatatattccagcagggatttcagttttttcacatgggctatgctgcggcgttgtcagtcattctgtttgtcgtgattctcttggttacacttatccaattccgttttgtgggcaaaggagcaacatacgacatgagttga

SEQ ID NO: 440 - DNA, 939 bp, Artificial
  Substituion in SEQ ID NO 427
gtgagaattatggggatcgacgccagcgctcggctgactcggcaagtagaaacaaatgcttcatacaacatcggcaggcgactggctccttacgcctttatattcccgagtttcataggagtattggcgtttcttcttgtacctgctgtcgcagtgctgttaataagcctcttcaattggaatatgttatcaccccctaaatttgttgggcttcgtaactatcttgacatctttcaagatccccttgcactccactccatgcttgtgacagtgtattatgttttgctcaatattccggtccaaactgtgttggccattttgcttgcgcttttgttgaaccgcagacttccgggaatggggatgtttcgagcgttctttgtccttccttggctggccatgccggtagctatctcagtggtgtggaacttgatctttgatccaaccaatggcgttctcaatgacgtgttaactgccgttggcctgcacccgcagcagtggctttcatcgccagtagaagccctgccttgcgttgctgcagtaaacatatggcaatggaccgggtataacatgctctttttccttgcggggctacaaagtatcccgtcccatctttatgaagcagcgaatatcgatggggcggggcgactgcgaaagttcttttcaatcaccttgccactgctcaggccgacactgttgttcgtgctgatcacgagtgtgatcggctcctttcaagtgttcgacactgtctatgtgatgacacaaggaggtcccggtacagcgacgaacgtttacaactactatatattccagcagggatttcagttttttcacatgggctatgctgcggcgttgtcagtcattctgtttgtcgtgattctcttggttacacttatccaattccgttttgtgggcaaaggagcaacatacgacatgagttga

SEQ ID NO: 441 - DNA, 939 bp, Artificial
  Substituion in SEQ ID NO 427
gtgagaattatggggatcgacgccagcgctcggctgactcggcaagtagaaacaaatgcttcatacaacatcggcaggcgactggctccttacgcctttatattcccgagtttcataggagtattggcgtttcttcttgtacctgctgtcgcagtgctgattataagcctcttcaattggaatatgttatcaccccctaaatttgttgggcttcgtaactatcttgacatctttcaagatccccttgcactccactccatgcttgtgacagtgtattatgttttgctcaatattccggtccaaactgtgttggccattttgcttgcgcttttgttgaaccgcagacttccgggaatggggatgtttcgagcgttctttgtccttccttggctggccatgccggtagctatctcagtggtgtggaacttgatctttgatccaaccaatggcgttctcaatgacgtgttaactgccgttggcctgcacccgcagcagtggctttcatcgccagtagaagccctgccttgcgttgctgcagtaaacatatggcaatggaccgggtataacatgctctttttcattgcggggctacaaagtatcccgtcccatctttatgaagcagcgaatatcgatggggcggggcgactgcgaaagttcttttcaatcaccttgccactgctcaggccgacactgttgttcgtgctgatcacgagtgtgatcggctcctttcaagtgttcgacactgtctatgtgatgacacaaggaggtcccggtacagcgacgaacgtttacaactactatatattccagcagggatttcagttttttcacatgggctatgctgcggcgttgtcagtcattctgtttgtcgtgattctcttggttacacttatccaattccgttttgtgggcaaaggagcaacatacgacatgagttga

SEQ ID NO: 442 - DNA, 939 bp, Artificial
  Substituion in SEQ ID NO 427
gtgagaattatggggatcgacgccagcgctcggctgactcggcaagtagaaacaaatgcttcatacaacatcggcaggcgactggctccttacgcctttatattcccgagtttcataggagtattggcgtttcttcttgtacctgctgtcgcagtgctgattataagcctcttcaattggaatatgatttcaccccctaaatttgttgggcttcgtaactatcttgacatctttcaagatccccttgcactccactccatgcttgtgacagtgtattatgttttgctcaatattccggtccaaactgtgttggccattttgcttgcgcttttgttgaaccgcagacttccgggaatggggatgtttcgagcgttctttgtccttccttggctggccatgccggtagctatctcagtggtgtggaacttgatctttgatccaaccaatggcgttctcaatgacgtgttaactgccgttggcctgcacccgcagcagtggctttcatcgccagtagaagccctgccttgcgttgctgcagtaaacatatggcaatggaccgggtataacatgctctttttccttgcggggctacaaagtatcccgtcccatctttatgaagcagcgaatatcgatggggcggggcgactgcgaaagttcttttcaatcaccttgccactgctcaggccgacactgttgttcgtgctgatcacgagtgtgatcggctcctttcaagtgttcgacactgtctatgtgatgacacaaggaggtcccggtacagcgacgaacgtttacaactactatatattccagcagggatttcagttttttcacatgggctatgctgcggcgttgtcagtcattctgtttgtcgtgattctcttggttacacttatccaattccgttttgtgggcaaaggagcaacatacgacatgagttga

SEQ ID NO: 443 - protein, 459 aa, Alicyclobacillus acidocaldarius
MTRSHSRQAVGVTERDGGRFALLVEAPPAAAPQTRSWADTPLGFGGGRPPWQRVLGEVRPHPRAPLRARTPVGPMGQVVRATNARNPCSLLRSQNVFGYIDADSRVVGSGCRKRFGCAGGSQKGFAAMRVTIRDVARAAGVSVTTVSRALNGAADVGEETRQRVIEVAKQLNYRPSHVARSLVLRKSQNIGLLVSDFRKGSHHFLYDVLVGVHDTLAEYGYDVTLVSTDTARQQLVSYVDFCRARGLDGVIVMGIRLDDPYVEEVVESTLPSVVIDLPLLSRHCGYVMTDNVNGARYAVRHLVSRGCRRIGFVNGAAHAAVSRERLRGFEDAVRQYVGGFDERLVVYGDFTLEGGQRALAELLAKAPDVDGVFFASDLMAIGGIQHCKAMGIRIPDDLAVVGFDDIDLARFVTPALTTVAQPRYEMGCEAAKMLVHMLQKGEMPSGTLLPPQLVVRETA

SEQ ID NO: 444 - DNA, 1380 bp, Alicyclobacillus acidocaldarius
gtgacgcgctcgcattcgcgtcaggcggttggggtcaccgagcgcgacggtgggaggtttgcgcttctagttgaagcgcctcccgccgcagcgcctcaaacgcggagttgggcggatacgccgcttggctttggcggaggccggccgccatggcagcgagtgcttggcgaggttcgcccgcatccacgtgcgcctctgcgagcccgtacccctgtcggcccgatgggacaggttgtacgagccacaaacgcacggaatccatgttccctcttgcgttcccaaaacgttttcgggtatattgatgctgactcgcgtgtggtaggttcgggttgccgaaaacgttttggatgcgccggaggctcgcaaaaggggtttgccgccatgagagtcaccattcgcgacgtggcgcgcgcagcaggcgtttccgtcacgacggtgtcgagggcgctgaatggcgccgcggacgtcggtgaagagacgcgccagcgcgtcattgaggtcgccaagcaactgaactatcgcccgagccacgtggcgcggagcctcgtgctcaggaagagccagaacatcgggcttttggtgtccgattttcgcaaaggcagccaccactttctctacgacgttttggtcggcgtacacgacacgcttgccgagtacgggtacgatgtcacgctggtcagcacggacaccgcccgccagcaactggtgagctacgtggacttttgccgggcgcgagggctggacggcgtgatcgtcatgggcattcgcctggacgatccgtacgtcgaggaggtcgtggagtccacgctgccgagcgtcgtgatcgatctgccgctgctcagccggcactgcggttacgtgatgacggacaacgtgaacggcgcgcgctacgcggtgaggcacctcgtatcccgggggtgcaggcgcatcggttttgtgaacggcgccgcgcacgctgcggtgagccgcgagcggctgaggggattcgaggacgccgtgcgccaatatgtgggggggttcgacgagcgcctcgtggtctatggggatttcacgctcgaagggggacagcgcgcgctcgccgagctgctcgccaaagcgccggacgtggatggcgtgttcttcgcgagcgatctcatggccatcggaggcatccaacactgcaaggcgatgggcatccgcattccggacgatctcgcggtggtcggatttgacgatatcgacctcgcgcgtttcgtgacgcccgcgctgacgacggtcgcacagccgcggtatgagatgggctgcgaagcggccaagatgctcgtccatatgctgcagaagggcgagatgccatcaggcacgctgttgccgccgcaactcgtcgtgcgcgagacggcctga

SEQ ID NO: 445 - protein, 330 aa, Bacillus sp. NRRL B-14911
TIKDIAKAAGVSVTTVSRALNGYSDVNEKTREKIMSVAKELNYSPNTLARSLVMNKSKTIGLLVSGLNKGSVKDNFTFEVLSGVNDYVSETDYDLVLFSTTSIKQREKTYTQLCRERRVDGVIMQGIRTDDPYLQEVVESDIPCVLIDIPIETDTAGYITTDNKLGAKKAIEHLIRLGHRNIAMINGHEYAFVSQQRLQGFEEAMQGAGLSLNKEWIVNGEFNEEAAESAAVKLLKEHHEISAIFCASDLMALGVMKAAKRLNLQVPEELSVVGYDDIMLSSYVSPPLTTIAQNKFLMGYEAAKMLINTLEEKEEPHVVTLDTELKIRET

SEQ ID NO: 446 - protein, 333 aa, Thermoanaerobacter pseudethanolicus ATCC 33223
MAVTIKDIAKYAGVSVTTVSRALNGYPDVSEETRERIKKIAEQLNYTPNSIARGLVTNKTHTVGLIVSELIKPGAYHPFFLEVLAGIKAGLKKDKYDLILFTVDPESQDATSYEKLCNDRKVEGAIVEGLRLSDPYIEEIKRTQIPTVLIDIPILTDKVGYVSSDNVQAAFEATSYLIKLGHRNIGFINGHGDAAVSFERLEGYKKALEKNNIPYKEEYVVFDDFTQEGGYNSFKTLVFEHPEITAVFHASDLMAIGSFKAAKDLGMKVPDDISIVGFDDIELASLITPGLTTIRQDTFKMGYNAAKHLLSIIKGEKPQHILIPHKLVIRDSA

SEQ ID NO: 447 - protein, 333 aa, Thermoanaerobacter sp. X514
MAVTIKDIAKYAGVSVTTVSRALNGYPDVSEETRERIKKIAEQLNYTPNSIARGLVTNKTHTVGLIVSELIKPGAYHPFFLEVLAGIKAGLKKDKYDLILFTVDPESQDATSYEKLCNDRKVEGAIVEGLRLSDPYIEEIKRTQIPTVLIDIPILTDKVGYVSSDNVQAAFEATSYLIKLGHRNIGFINGHNDAAVSFERLEGYKKALEKNNIPYKEEYVVFDDFTQEGGYNSFKTLVFEHPEITAVFHASDLMAIGSFKAAKDLGMKVPDDISIVGFDDIELASLITPGLTTIRQDTFKMGYNAAKHLLSIIKGEKPQHILIPHKLVIRDSA

SEQ ID NO: 448 - protein, 330 aa, Geobacillus thermodenitrificans NG80-2
TIKDIAKAAGVSITTVSRALNGYSDVNENTRQKIIDIARQLNYIPNTLARGLVMNKSKTIGLLVSGLTKESAKDNFTFEVLAGVNEYVSEVDYDMVLFSTTSTKQREKTYTQLCRERRVDGAILQGIRTDDPYLHEVVESDIPCVLIDIPIESRTVGYVTTDNVLGAKKAVRHLIELGHKRIAMINGYEYAFVSEQRLKGFKEALLEAGLPVREYWIANGAFREEIAEQEALRLLQHYPEITAFFCASDLMALGVIKAVKRLGKRVPDDVAVIGYDDIILASYSSPSLSTIAQDKFAMGYEAAKLLIAMLEGKADSHIKILQTELKARES

SEQ ID NO: 449 - protein, 333 aa, Thermoanaerobacter tengcongensis MB4
MAVTIKDIAKYAGVSVTTVSRALNGYPDVSEETRAKIKKIAEELNYTPNSIARGLVTNKTQTIGMVVSELIKPGVYHPFFLEVLAGIKAGLKKDRYDLILFTVDPESQDATSYEKLCNDRKVEGAIVEGLRLSDPYIEEIKGTQIPTVLIDIPILTDKVGYVSSDNVQAAFEATSYLIKLGHKNIGFINGHKDAAVSFERLEGYKKALEKNDIPYREEYVIFADFTQEGGYNAFKTLIFEHPEITAIFHASDLMAMGSYRAAKDLGMRIPEDISLVGFDDIELASLITPALTTIRQDTFKMGYTAAKHLLAIIRGEKPQHIVIPHKLVVRDSA

SEQ ID NO: 450 - protein, 459 aa, Artificial
  Substituion in SEQ ID NO 443
MTRSHSRQAVGVTEREGGRFALLVEAPPAAAPQTRSWADTPLGFGGGRPPWQRVLGEVRPHPRAPLRARTPVGPMGQVVRATNARNPCSLLRSQNVFGYIDADSRVVGSGCRKRFGCAGGSQKGFAAMRVTIRDVARAAGVSVTTVSRALNGAADVGEETRQRVIEVAKQLNYRPSHVARSLVLRKSQNIGLLVSDFRKGSHHFLYDVLVGVHDTLAEYGYDVTLVSTDTARQQLVSYVDFCRARGLDGVIVMGIRLDDPYVEEVVESTLPSVVIDLPLLSRHCGYVMTDNVNGARYAVRHLVSRGCRRIGFVNGAAHAAVSRERLRGFEDAVRQYVGGFDERLVVYGDFTLEGGQRALAELLAKAPDVDGVFFASDLMAIGGIQHCKAMGIRIPDDLAVVGFDDIDLARFVTPALTTVAQPRYEMGCEAAKMLVHMLQKGEMPSGTLLPPQLVVRETA

SEQ ID NO: 451 - protein, 459 aa, Artificial
  Substituion in SEQ ID NO 443
MTRSHSRQAVGVTERDGGRFALLVEAPPAAAPQTRSWADTPLGFGGGRPPWQRVLGEVRPHPRAPLRARTPVGPMGQVVRATNARNPCSLLRSQNVFGYIDADSRVVGSGCRKRFGCAGGSQKGFAAMRVTIRDVARAAGVSVTTVSRALNGAADVGEETRQRVIEVAKQLNYRPSHVARSLVLRKSQNIGLLVSDFRKGSHHFLYDVLVGVHDTLAEYGYDVTLVSTDTARQQLVSYVDFCRARGLDGVIVMGIRLDDPYVDEVVESTLPSVVIDLPLLSRHCGYVMTDNVNGARYAVRHLVSRGCRRIGFVNGAAHAAVSRERLRGFEDAVRQYVGGFDERLVVYGDFTLEGGQRALAELLAKAPDVDGVFFASDLMAIGGIQHCKAMGIRIPDDLAVVGFDDIDLARFVTPALTTVAQPRYEMGCEAAKMLVHMLQKGEMPSGTLLPPQLVVRETA

SEQ ID NO: 452 - protein, 459 aa, Artificial
  Substituion in SEQ ID NO 443
MTRSHSRQAVGVTERDGGKFALLVEAPPAAAPQTRSWADTPLGFGGGRPPWQRVLGEVRPHPRAPLRARTPVGPMGQVVRATNARNPCSLLRSQNVFGYIDADSRVVGSGCRKRFGCAGGSQKGFAAMRVTIRDVARAAGVSVTTVSRALNGAADVGEETRQRVIEVAKQLNYRPSHVARSLVLRKSQNIGLLVSDFRKGSHHFLYDVLVGVHDTLAEYGYDVTLVSTDTARQQLVSYVDFCRARGLDGVIVMGIRLDDPYVEEVVESTLPSVVIDLPLLSRHCGYVMTDNVNGARYAVRHLVSRGCRRIGFVNGAAHAAVSRERLRGFEDAVRQYVGGFDERLVVYGDFTLEGGQRALAELLAKAPDVDGVFFASDLMAIGGIQHCKAMGIRIPDDLAVVGFDDIDLARFVTPALTTVAQPRYEMGCEAAKMLVHMLQKGEMPSGTLLPPQLVVRETA

SEQ ID NO: 453 - protein, 459 aa, Artificial
  Substituion in SEQ ID NO 443
MTRSHSRQAVGVTERDGGRFALLVEAPPAAAPQTRSWADTPLGFGGGRPPWQRVLGEVRPHPRAPLRARTPVGPMGQVVRATNARNPCSLLRSQNVFGYIDADSRVVGSGCRKRFGCAGGSQKGFAAMRVTIRDVARAAGVSVTTVSRALNGAADVGEETRQRVIEVAKQLNYRPSHVARSLVLRKSQNIGLLVSDFRKGSHHFLYDVLVGVHDTLAEYGYDVTLVSTDTARQQLVSYVDFCRARGLDGVIVMGIRLDDPYVEEVVESTLPSVVIDLPLLSRHCGYVMTDNVNGARYAVRHLVSRGCRRIGFVNGAAHAAVSRERLRGFEDAIRQYVGGFDERLVVYGDFTLEGGQRALAELLAKAPDVDGVFFASDLMAIGGIQHCKAMGIRIPDDLAVVGFDDIDLARFVTPALTTVAQPRYEMGCEAAKMLVHMLQKGEMPSGTLLPPQLVVRETA

SEQ ID NO: 454 - protein, 459 aa, Artificial
  Substituion in SEQ ID NO 443
MTRSHSRQAVGVTERDGGRFALLVEAPPAAAPQTRSWADTPLGFGGGRPPWQRVLGEVRPHPRAPLRARTPVGPMGQVVRATNARNPCSLLRSQNVFGYIDADSRVVGSGCRKRFGCAGGSQKGFAAMRVTIRDVARAAGVSVTTVSRALNGAADVGEETRQRVIEVAKQLNYRPSHVARSLVLRKSQNIGLLVSDFRKGSHHFLYDVLVGVHDTLAEYGYDVTLVSTETARQQLVSYVDFCRARGLDGVIVMGIRLDDPYVEEVVESTLPSVVIDLPLLSRHCGYVMTDNVNGARYAVRHLVSRGCRRIGFVNGAAHAAVSRERLRGFEDAVRQYVGGFDERLVVYGDFTLEGGQRALAELLAKAPDVDGVFFASDLMAIGGIQHCKAMGIRIPDDLAVVGFDDIDLARFVTPALTTVAQPRYEMGCEAAKMLVHMLQKGEMPSGTLLPPQLVVRETA

SEQ ID NO: 455 - DNA, 1380 bp, Artificial
  Substituion in SEQ ID NO 444
gtgacgcgctcgcattcgcgtcaggcggttggggtcaccgagcgcgaaggtgggaggtttgcgcttctagttgaagcgcctcccgccgcagcgcctcaaacgcggagttgggcggatacgccgcttggctttggcggaggccggccgccatggcagcgagtgcttggcgaggttcgcccgcatccacgtgcgcctctgcgagcccgtacccctgtcggcccgatgggacaggttgtacgagccacaaacgcacggaatccatgttccctcttgcgttcccaaaacgttttcgggtatattgatgctgactcgcgtgtggtaggttcgggttgccgaaaacgttttggatgcgccggaggctcgcaaaaggggtttgccgccatgagagtcaccattcgcgacgtggcgcgcgcagcaggcgtttccgtcacgacggtgtcgagggcgctgaatggcgccgcggacgtcggtgaagagacgcgccagcgcgtcattgaggtcgccaagcaactgaactatcgcccgagccacgtggcgcggagcctcgtgctcaggaagagccagaacatcgggcttttggtgtccgattttcgcaaaggcagccaccactttctctacgacgttttggtcggcgtacacgacacgcttgccgagtacgggtacgatgtcacgctggtcagcacggacaccgcccgccagcaactggtgagctacgtggacttttgccgggcgcgagggctggacggcgtgatcgtcatgggcattcgcctggacgatccgtacgtcgaggaggtcgtggagtccacgctgccgagcgtcgtgatcgatctgccgctgctcagccggcactgcggttacgtgatgacggacaacgtgaacggcgcgcgctacgcggtgaggcacctcgtatcccgggggtgcaggcgcatcggttttgtgaacggcgccgcgcacgctgcggtgagccgcgagcggctgaggggattcgaggacgccgtgcgccaatatgtgggggggttcgacgagcgcctcgtggtctatggggatttcacgctcgaagggggacagcgcgcgctcgccgagctgctcgccaaagcgccggacgtggatggcgtgttcttcgcgagcgatctcatggccatcggaggcatccaacactgcaaggcgatgggcatccgcattccggacgatctcgcggtggtcggatttgacgatatcgacctcgcgcgtttcgtgacgcccgcgctgacgacggtcgcacagccgcggtatgagatgggctgcgaagcggccaagatgctcgtccatatgctgcagaagggcgagatgccatcaggcacgctgttgccgccgcaactcgtcgtgcgcgagacggcctga

SEQ ID NO: 456 - DNA, 1380 bp, Artificial
  Substituion in SEQ ID NO 444
gtgacgcgctcgcattcgcgtcaggcggttggggtcaccgagcgcgacggtgggaggtttgcgcttctagttgaagcgcctcccgccgcagcgcctcaaacgcggagttgggcggatacgccgcttggctttggcggaggccggccgccatggcagcgagtgcttggcgaggttcgcccgcatccacgtgcgcctctgcgagcccgtacccctgtcggcccgatgggacaggttgtacgagccacaaacgcacggaatccatgttccctcttgcgttcccaaaacgttttcgggtatattgatgctgactcgcgtgtggtaggttcgggttgccgaaaacgttttggatgcgccggaggctcgcaaaaggggtttgccgccatgagagtcaccattcgcgacgtggcgcgcgcagcaggcgtttccgtcacgacggtgtcgagggcgctgaatggcgccgcggacgtcggtgaagagacgcgccagcgcgtcattgaggtcgccaagcaactgaactatcgcccgagccacgtggcgcggagcctcgtgctcaggaagagccagaacatcgggcttttggtgtccgattttcgcaaaggcagccaccactttctctacgacgttttggtcggcgtacacgacacgcttgccgagtacgggtacgatgtcacgctggtcagcacggacaccgcccgccagcaactggtgagctacgtggacttttgccgggcgcgagggctggacggcgtgatcgtcatgggcattcgcctggacgatccgtacgtcgatgaggtcgtggagtccacgctgccgagcgtcgtgatcgatctgccgctgctcagccggcactgcggttacgtgatgacggacaacgtgaacggcgcgcgctacgcggtgaggcacctcgtatcccgggggtgcaggcgcatcggttttgtgaacggcgccgcgcacgctgcggtgagccgcgagcggctgaggggattcgaggacgccgtgcgccaatatgtgggggggttcgacgagcgcctcgtggtctatggggatttcacgctcgaagggggacagcgcgcgctcgccgagctgctcgccaaagcgccggacgtggatggcgtgttcttcgcgagcgatctcatggccatcggaggcatccaacactgcaaggcgatgggcatccgcattccggacgatctcgcggtggtcggatttgacgatatcgacctcgcgcgtttcgtgacgcccgcgctgacgacggtcgcacagccgcggtatgagatgggctgcgaagcggccaagatgctcgtccatatgctgcagaagggcgagatgccatcaggcacgctgttgccgccgcaactcgtcgtgcgcgagacggcctga

SEQ ID NO: 457 - DNA, 1380 bp, Artificial
  Substituion in SEQ ID NO 444
gtgacgcgctcgcattcgcgtcaggcggttggggtcaccgagcgcgacggtgggaaatttgcgcttctagttgaagcgcctcccgccgcagcgcctcaaacgcggagttgggcggatacgccgcttggctttggcggaggccggccgccatggcagcgagtgcttggcgaggttcgcccgcatccacgtgcgcctctgcgagcccgtacccctgtcggcccgatgggacaggttgtacgagccacaaacgcacggaatccatgttccctcttgcgttcccaaaacgttttcgggtatattgatgctgactcgcgtgtggtaggttcgggttgccgaaaacgttttggatgcgccggaggctcgcaaaaggggtttgccgccatgagagtcaccattcgcgacgtggcgcgcgcagcaggcgtttccgtcacgacggtgtcgagggcgctgaatggcgccgcggacgtcggtgaagagacgcgccagcgcgtcattgaggtcgccaagcaactgaactatcgcccgagccacgtggcgcggagcctcgtgctcaggaagagccagaacatcgggcttttggtgtccgattttcgcaaaggcagccaccactttctctacgacgttttggtcggcgtacacgacacgcttgccgagtacgggtacgatgtcacgctggtcagcacggacaccgcccgccagcaactggtgagctacgtggacttttgccgggcgcgagggctggacggcgtgatcgtcatgggcattcgcctggacgatccgtacgtcgaggaggtcgtggagtccacgctgccgagcgtcgtgatcgatctgccgctgctcagccggcactgcggttacgtgatgacggacaacgtgaacggcgcgcgctacgcggtgaggcacctcgtatcccgggggtgcaggcgcatcggttttgtgaacggcgccgcgcacgctgcggtgagccgcgagcggctgaggggattcgaggacgccgtgcgccaatatgtgggggggttcgacgagcgcctcgtggtctatggggatttcacgctcgaagggggacagcgcgcgctcgccgagctgctcgccaaagcgccggacgtggatggcgtgttcttcgcgagcgatctcatggccatcggaggcatccaacactgcaaggcgatgggcatccgcattccggacgatctcgcggtggtcggatttgacgatatcgacctcgcgcgtttcgtgacgcccgcgctgacgacggtcgcacagccgcggtatgagatgggctgcgaagcggccaagatgctcgtccatatgctgcagaagggcgagatgccatcaggcacgctgttgccgccgcaactcgtcgtgcgcgagacggcctga

SEQ ID NO: 458 - DNA, 1380 bp, Artificial
  Substituion in SEQ ID NO 444
gtgacgcgctcgcattcgcgtcaggcggttggggtcaccgagcgcgacggtgggaggtttgcgcttctagttgaagcgcctcccgccgcagcgcctcaaacgcggagttgggcggatacgccgcttggctttggcggaggccggccgccatggcagcgagtgcttggcgaggttcgcccgcatccacgtgcgcctctgcgagcccgtacccctgtcggcccgatgggacaggttgtacgagccacaaacgcacggaatccatgttccctcttgcgttcccaaaacgttttcgggtatattgatgctgactcgcgtgtggtaggttcgggttgccgaaaacgttttggatgcgccggaggctcgcaaaaggggtttgccgccatgagagtcaccattcgcgacgtggcgcgcgcagcaggcgtttccgtcacgacggtgtcgagggcgctgaatggcgccgcggacgtcggtgaagagacgcgccagcgcgtcattgaggtcgccaagcaactgaactatcgcccgagccacgtggcgcggagcctcgtgctcaggaagagccagaacatcgggcttttggtgtccgattttcgcaaaggcagccaccactttctctacgacgttttggtcggcgtacacgacacgcttgccgagtacgggtacgatgtcacgctggtcagcacggacaccgcccgccagcaactggtgagctacgtggacttttgccgggcgcgagggctggacggcgtgatcgtcatgggcattcgcctggacgatccgtacgtcgaggaggtcgtggagtccacgctgccgagcgtcgtgatcgatctgccgctgctcagccggcactgcggttacgtgatgacggacaacgtgaacggcgcgcgctacgcggtgaggcacctcgtatcccgggggtgcaggcgcatcggttttgtgaacggcgccgcgcacgctgcggtgagccgcgagcggctgaggggattcgaggacgccattcgccaatatgtgggggggttcgacgagcgcctcgtggtctatggggatttcacgctcgaagggggacagcgcgcgctcgccgagctgctcgccaaagcgccggacgtggatggcgtgttcttcgcgagcgatctcatggccatcggaggcatccaacactgcaaggcgatgggcatccgcattccggacgatctcgcggtggtcggatttgacgatatcgacctcgcgcgtttcgtgacgcccgcgctgacgacggtcgcacagccgcggtatgagatgggctgcgaagcggccaagatgctcgtccatatgctgcagaagggcgagatgccatcaggcacgctgttgccgccgcaactcgtcgtgcgcgagacggcctga

SEQ ID NO: 459 - DNA, 1380 bp, Artificial
  Substituion in SEQ ID NO 444
gtgacgcgctcgcattcgcgtcaggcggttggggtcaccgagcgcgacggtgggaggtttgcgcttctagttgaagcgcctcccgccgcagcgcctcaaacgcggagttgggcggatacgccgcttggctttggcggaggccggccgccatggcagcgagtgcttggcgaggttcgcccgcatccacgtgcgcctctgcgagcccgtacccctgtcggcccgatgggacaggttgtacgagccacaaacgcacggaatccatgttccctcttgcgttcccaaaacgttttcgggtatattgatgctgactcgcgtgtggtaggttcgggttgccgaaaacgttttggatgcgccggaggctcgcaaaaggggtttgccgccatgagagtcaccattcgcgacgtggcgcgcgcagcaggcgtttccgtcacgacggtgtcgagggcgctgaatggcgccgcggacgtcggtgaagagacgcgccagcgcgtcattgaggtcgccaagcaactgaactatcgcccgagccacgtggcgcggagcctcgtgctcaggaagagccagaacatcgggcttttggtgtccgattttcgcaaaggcagccaccactttctctacgacgttttggtcggcgtacacgacacgcttgccgagtacgggtacgatgtcacgctggtcagcacggaaaccgcccgccagcaactggtgagctacgtggacttttgccgggcgcgagggctggacggcgtgatcgtcatgggcattcgcctggacgatccgtacgtcgaggaggtcgtggagtccacgctgccgagcgtcgtgatcgatctgccgctgctcagccggcactgcggttacgtgatgacggacaacgtgaacggcgcgcgctacgcggtgaggcacctcgtatcccgggggtgcaggcgcatcggttttgtgaacggcgccgcgcacgctgcggtgagccgcgagcggctgaggggattcgaggacgccgtgcgccaatatgtgggggggttcgacgagcgcctcgtggtctatggggatttcacgctcgaagggggacagcgcgcgctcgccgagctgctcgccaaagcgccggacgtggatggcgtgttcttcgcgagcgatctcatggccatcggaggcatccaacactgcaaggcgatgggcatccgcattccggacgatctcgcggtggtcggatttgacgatatcgacctcgcgcgtttcgtgacgcccgcgctgacgacggtcgcacagccgcggtatgagatgggctgcgaagcggccaagatgctcgtccatatgctgcagaagggcgagatgccatcaggcacgctgttgccgccgcaactcgtcgtgcgcgagacggcctga

SEQ ID NO: 460 - protein, 437 aa, Alicyclobacillus acidocaldarius
METSGVKPIGWEVERKMRKPFLGIAGAAVVAMGAVTACGQAQSAPSNQANVGSASAAPIHLTLGMWASSPAEKQLVERQIALFEKENPNIKVSIQVITGNYLQALQPMLAAHDAPDIFYVDSSYAPTLEASGAIMPLDSFIKQDHVDLSDFQKNLLDAFTWQGHIYGLPKDMNTMALEYNPALLAKAGIQSPPKTFAQFDQDAAKLKAKGIVPLDMPIDVARYYPFIVDMGGSYYNKATNQATFTNKANVAGLTWFMKEMESGNFVTPQDQGGSWAGVPFAEGKAAMALEGAWIVPFMQQTAPKMKYGIADFPSLNGHDANMLFTVAYEMSKYAKNPDAAAKLLFFMTGKEALKMTADSGLAIPSRTSEQGEFLKKYPSYKGFVDGLKGAIPYQFGTLGQNFLDAINNATQQGILKKESAQQVLSQAQQTLASQMND

SEQ ID NO: 461 - DNA, 1314 bp, Alicyclobacillus acidocaldarius
atggagacaagcggggtcaaaccgattgggtgggaggtcgaacgaaagatgaggaaaccatttcttgggatcgcgggtgcggcagtggtcgcgatgggcgcggtgacggcatgcggccaggcgcagagcgcgccctccaaccaggcgaacgtcggcagcgcgtcggcggcgcccattcatctgacgcttggcatgtgggcgtcgagcccggcggaaaagcagctcgtggagcgtcagattgccttgtttgagaaggaaaatccgaacatcaaggtgagcatccaggtcatcacgggcaactacctgcaggcgctgcagccgatgctcgccgcgcacgacgcgccggacatcttctacgtggattcgtcctacgcgccgacgctcgaggcttcgggcgccatcatgccgctcgacagcttcatcaagcaggatcatgtcgatttgtccgacttccagaagaacctgctcgacgcgttcacctggcaggggcacatctacggcctgccgaaggacatgaacacgatggccttggagtacaacccggcgctcctcgccaaggcgggcatccagtcgccgccgaagacgttcgcgcagtttgaccaggacgccgcgaagctcaaggccaagggcattgtgccgctggacatgccgattgacgtggcgcgctattatccgttcatcgtcgacatgggcgggagctactacaacaaggccacgaaccaggccaccttcaccaacaaggcgaacgtcgcgggcctcacgtggtttatgaaagagatggaaagcggcaacttcgtgaccccgcaagaccaaggcgggtcctgggcgggtgtcccgttcgcagagggcaaggcggcgatggcccttgagggcgcttggattgtgccgttcatgcagcagaccgcgccgaagatgaagtacggcattgcggacttcccgtcgctcaacgggcacgatgcgaacatgctgtttacggtcgcgtacgagatgtcgaagtacgcgaagaacccggatgctgccgcgaagttgctcttcttcatgacgggcaaagaggcgctcaagatgacggccgattcgggcctcgccattccctctcggaccagcgagcagggcgagtttctgaagaagtatccgtcgtacaagggcttcgtggacggtctcaagggcgccattccgtatcagttcggcacgctcgggcagaacttcctcgacgccatcaacaatgccacgcaacaaggcattctgaagaaggagtcggcgcagcaagtcttgagtcaggcgcagcagacgctcgcttcacagatgaacgactga

SEQ ID NO: 462 - protein, 387 aa, Thermoanaerobacter pseudethanolicus ATCC 33223
TSSANETNTQKQETAKPVTIKLGMWSSSPAEKKIVDDQIAKFKEKYPNIDVQIETIVGDYMQKLQTELASNTAPDIFYLDSMPAPQLMSSGVLEPLDDYIKKYNVDVNDFEPALLSAFQWDGKTYGLPKDFNTLALFYNKDMFKAAGINEPPKTWEELRDVAKKLTKDGVKGLVLSADLARFDAFINQNGGSVYQDGKVTLNLPENAQALDFYVSLITKDKVADTPQNMGEGWNGDAFAAKKAAMAIEGGWMIPFLKEKAPDLNYGIAELPAGKQKSTMAFTVAYVMNKNSKHKDEAFKLIEFLTGKEGQQFVVDSGLALPSRKSMQEGFKEKYPERAAFVDGASYAVPWQFGLYGTKVVDAANKACEALIMKQISSAQQALDNAQK

SEQ ID NO: 463 - protein, 374 aa, Thermoanaerobacter tengcongensis MB4
TSKPVTIKLGMWSSSPAEKKIVDDQIAKFKEKYPNIDVQIETIVGDYMQKLQTELASNTAPDIFYLDSMPAPQLMSSGVLEPLDEYIKKYNVDVNDFEPALLSAFQWEGKTYGLPKDYNTLVLFYNKDMFKEAGINEPPKTWEELRETAKKLTKNGVKGIVLSADLARFDAFINQNDGSVYKDGKVTLNLPQNAEALDFYVGLIIRDKVADTPQNMGEGWNGDAFAAKKAAMAIEGGWMIPFLKEKAPDLNYGIAELPAGKKKSTMAFTVAYVMNKNSKHKDEAFKLIEFLTGKEGQQFVVDSGLALPSRKSMEANFKEKYPERAPFIDGASYAVPWQFGLYGTKLVDAANKACEALIMKQIGSAQEALDNAQK

SEQ ID NO: 464 - protein, 363 aa, Caldicellulosiruptor saccharolyticus DSM 8903
AASKITLKLGAWASSPAEKKIVQNQIAAFKKLYPNVDVRITEIVGDYNQKIQLLMASKTEPDIFYMDSMPAWQYIAKGVLEPLDYWMKKYNVKTIGYESSLLQPFIYKGKVYGLPKDYNTLVLFYNKEMFKQAGLTRPPRTWQELKDYAKKLTTGKVVGLTMNLELARIQPFAYQNGGKVFDGTKPVFTDPKALEGFKFALDLFKEGICKTPKDLGAGWVGDAFADKKAAMTIEGGWMIPFLNERKIPKDSYGIAELPAGPAGKSTMAFTVAYVMSKNSKHKPEAFKLIRFLTGEGGQKFVVEAGLALPSLKSAGVNFAKTYPERKALVDGAKYAQVYFYGLDGTKVVDVFNKAFEDYVIGKK

SEQ ID NO: 465 - protein, 390 aa, Geobacillus thermodenitrificans NG80-2
SEQANGGNKQGEKVEVTLAGWGGNPSEQKLLQQTIDDFEKKHPDIKVKYEVIADQYMDVIKTRLSGGQGPDVFYLDAFEAPALIETGALEPLDEYVTDEFDIDDFEKPMLDAFKGEDGKIYGFPKDYSTLALFYNKKMLEEAGVEVPKTWDELREAAKKLTKGKDVYGFGVAPELARLYYIAESKGGKVVTDNKASFADSKVVDALQPIVDMHLKDKTAAQPNEVGATWGGEMFGQGKAAMVIEGNWAIPFLQDTFPNLEFGTAELPTINGKKATMAYTVAYVMNKDSQKKEAAWKLISYLTGKEGMKTWTSKGYALPTRKSVAAELGFDKDPLRAALVAGAPYATVWQNGTNLPIIVNNFNNQFVSAFLGERPLADALKEAEKTANSEI

SEQ ID NO: 466 - protein, 398 aa, Bacillus halodurans C-125
CNFADEEPSSEPTEGGNTDGEVVELTLTGWQSSPTEQRYFEETVATFEEQNPDIKVNINTIPDQYMDVLRTRLIGGEGPDVFFLDAFEAPGLIETGAVEPLDEYITDEFDLADFEQPLLEAFERNGVLYGLPKDTSTLALFYNIDMLEEAGFDGPPETWEELEEMAIALTNDDEYGFGVVTDLARLMFIAQSNGGQIATDNQATFADPRVVEALQPIVDMRNVDGSAVEPSEVGADWGGEMFGLERVAMVIEGNWTVPFLDENFEDVNYGVAEVPTINGNEGTMAYTVSYVMNRNSEHKEEAWRLIEFLTGKEGMELWTSSGLTLPTRASVSEKLDYADDPIYGPFIAGQSYATVWADDTNLPIVNNNFQNQFTSAFLGQRDLAEALKEAEEVANSEI

SEQ ID NO: 467 - protein, 437 aa, Artificial
  Substituion in SEQ ID NO 460
METSGVKPIGWEVERKMRKPFLGIAGAAVVAMGAVTACGQAQSAPSNQANVGSASAAPIHLTLGMWASSPAEKQLVERQIALFEKENPNIKVSIQVITGNYLQALQPMIAAHDAPDIFYVDSSYAPTLEASGAIMPLDSFIKQDHVDLSDFQKNLLDAFTWQGHIYGLPKDMNTMALEYNPALLAKAGIQSPPKTFAQFDQDAAKLKAKGIVPLDMPIDVARYYPFIVDMGGSYYNKATNQATFTNKANVAGLTWFMKEMESGNFVTPQDQGGSWAGVPFAEGKAAMALEGAWIVPFMQQTAPKMKYGIADFPSLNGHDANMLFTVAYEMSKYAKNPDAAAKLLFFMTGKEALKMTADSGLAIPSRTSEQGEFLKKYPSYKGFVDGLKGAIPYQFGTLGQNFLDAINNATQQGILKKESAQQVLSQAQQTLASQMND

SEQ ID NO: 468 - protein, 437 aa, Artificial
  Substituion in SEQ ID NO 460
METSGVKPIGWEVERKMRKPFLGIAGAAVVAMGAVTACGQAQSAPSNQANVGSASAAPIHLTLGMWASSPAEKQLVERQIALFEKENPNIKVSIQVITGNYLQALQPMLAAHDAPDIFYVDSSYAPTLEASGAIMPLDSFIKQDHVDLSDFQKNLLDAFTWQGHIYGLPKDMNTMALEYNPALLAKAGIQSPPKTFAQFDQDAAKLKAKGIVPLDMPIDVARYYPFIVDMGGSYYNKATNQATFTNKANVAGLTWFMKEMESGNFVTPQDQGGSWAGVPFAEGKAAMALEGAWIVPFMQQTAPKMKYGIADFPSLNGHDANMIFTVAYEMSKYAKNPDAAAKLLFFMTGKEALKMTADSGLAIPSRTSEQGEFLKKYPSYKGFVDGLKGAIPYQFGTLGQNFLDAINNATQQGILKKESAQQVLSQAQQTLASQMND

SEQ ID NO: 469 - protein, 437 aa, Artificial
  Substituion in SEQ ID NO 460
METSGVKPIGWEVERKMRKPFLGIAGAAVVAMGAVTACGQAQSAPSNQANVGSASAAPIHLTLGMWASSPAEKQLVERQIALFEKENPNIKVSIQVITGNYLQALQPMLAAHDAPDIFYVDSSYAPTLEASGAIMPLDSFIKQDHVDLSDFQKNLLDAFTWQGHIYGLPKDMNTMALEYNPALLAKAGIQSPPKTFAQFDQEAAKLKAKGIVPLDMPIDVARYYPFIVDMGGSYYNKATNQATFTNKANVAGLTWFMKEMESGNFVTPQDQGGSWAGVPFAEGKAAMALEGAWIVPFMQQTAPKMKYGIADFPSLNGHDANMLFTVAYEMSKYAKNPDAAAKLLFFMTGKEALKMTADSGLAIPSRTSEQGEFLKKYPSYKGFVDGLKGAIPYQFGTLGQNFLDAINNATQQGILKKESAQQVLSQAQQTLASQMND

SEQ ID NO: 470 - protein, 437 aa, Artificial
  Substituion in SEQ ID NO 460
METSGVKPIGWEVERKMRRPFLGIAGAAVVAMGAVTACGQAQSAPSNQANVGSASAAPIHLTLGMWASSPAEKQLVERQIALFEKENPNIKVSIQVITGNYLQALQPMLAAHDAPDIFYVDSSYAPTLEASGAIMPLDSFIKQDHVDLSDFQKNLLDAFTWQGHIYGLPKDMNTMALEYNPALLAKAGIQSPPKTFAQFDQDAAKLKAKGIVPLDMPIDVARYYPFIVDMGGSYYNKATNQATFTNKANVAGLTWFMKEMESGNFVTPQDQGGSWAGVPFAEGKAAMALEGAWIVPFMQQTAPKMKYGIADFPSLNGHDANMLFTVAYEMSKYAKNPDAAAKLLFFMTGKEALKMTADSGLAIPSRTSEQGEFLKKYPSYKGFVDGLKGAIPYQFGTLGQNFLDAINNATQQGILKKESAQQVLSQAQQTLASQMND

SEQ ID NO: 471 - protein, 437 aa, Artificial
  Substituion in SEQ ID NO 460
METSGVKPIGWEVERKMRKPFLGIAGAAVVAMGAVTACGQAQSAPSNQANVGSASAAPIHLTLGMWASSPAEKQLVERQIALFEKENPNLKVSIQVITGNYLQALQPMLAAHDAPDIFYVDSSYAPTLEASGAIMPLDSFIKQDHVDLSDFQKNLLDAFTWQGHIYGLPKDMNTMALEYNPALLAKAGIQSPPKTFAQFDQDAAKLKAKGIVPLDMPIDVARYYPFIVDMGGSYYNKATNQATFTNKANVAGLTWFMKEMESGNFVTPQDQGGSWAGVPFAEGKAAMALEGAWIVPFMQQTAPKMKYGIADFPSLNGHDANMLFTVAYEMSKYAKNPDAAAKLLFFMTGKEALKMTADSGLAIPSRTSEQGEFLKKYPSYKGFVDGLKGAIPYQFGTLGQNFLDAINNATQQGILKKESAQQVLSQAQQTLASQMND

SEQ ID NO: 472 - DNA, 1314 bp, Artificial
  Substituion in SEQ ID NO 461
atggagacaagcggggtcaaaccgattgggtgggaggtcgaacgaaagatgaggaaaccatttcttgggatcgcgggtgcggcagtggtcgcgatgggcgcggtgacggcatgcggccaggcgcagagcgcgccctccaaccaggcgaacgtcggcagcgcgtcggcggcgcccattcatctgacgcttggcatgtgggcgtcgagcccggcggaaaagcagctcgtggagcgtcagattgccttgtttgagaaggaaaatccgaacatcaaggtgagcatccaggtcatcacgggcaactacctgcaggcgctgcagccgatgattgccgcgcacgacgcgccggacatcttctacgtggattcgtcctacgcgccgacgctcgaggcttcgggcgccatcatgccgctcgacagcttcatcaagcaggatcatgtcgatttgtccgacttccagaagaacctgctcgacgcgttcacctggcaggggcacatctacggcctgccgaaggacatgaacacgatggccttggagtacaacccggcgctcctcgccaaggcgggcatccagtcgccgccgaagacgttcgcgcagtttgaccaggacgccgcgaagctcaaggccaagggcattgtgccgctggacatgccgattgacgtggcgcgctattatccgttcatcgtcgacatgggcgggagctactacaacaaggccacgaaccaggccaccttcaccaacaaggcgaacgtcgcgggcctcacgtggtttatgaaagagatggaaagcggcaacttcgtgaccccgcaagaccaaggcgggtcctgggcgggtgtcccgttcgcagagggcaaggcggcgatggcccttgagggcgcttggattgtgccgttcatgcagcagaccgcgccgaagatgaagtacggcattgcggacttcccgtcgctcaacgggcacgatgcgaacatgctgtttacggtcgcgtacgagatgtcgaagtacgcgaagaacccggatgctgccgcgaagttgctcttcttcatgacgggcaaagaggcgctcaagatgacggccgattcgggcctcgccattccctctcggaccagcgagcagggcgagtttctgaagaagtatccgtcgtacaagggcttcgtggacggtctcaagggcgccattccgtatcagttcggcacgctcgggcagaacttcctcgacgccatcaacaatgccacgcaacaaggcattctgaagaaggagtcggcgcagcaagtcttgagtcaggcgcagcagacgctcgcttcacagatgaacgactga

SEQ ID NO: 473 - DNA, 1314 bp, Artificial
  Substituion in SEQ ID NO 461
atggagacaagcggggtcaaaccgattgggtgggaggtcgaacgaaagatgaggaaaccatttcttgggatcgcgggtgcggcagtggtcgcgatgggcgcggtgacggcatgcggccaggcgcagagcgcgccctccaaccaggcgaacgtcggcagcgcgtcggcggcgcccattcatctgacgcttggcatgtgggcgtcgagcccggcggaaaagcagctcgtggagcgtcagattgccttgtttgagaaggaaaatccgaacatcaaggtgagcatccaggtcatcacgggcaactacctgcaggcgctgcagccgatgctcgccgcgcacgacgcgccggacatcttctacgtggattcgtcctacgcgccgacgctcgaggcttcgggcgccatcatgccgctcgacagcttcatcaagcaggatcatgtcgatttgtccgacttccagaagaacctgctcgacgcgttcacctggcaggggcacatctacggcctgccgaaggacatgaacacgatggccttggagtacaacccggcgctcctcgccaaggcgggcatccagtcgccgccgaagacgttcgcgcagtttgaccaggacgccgcgaagctcaaggccaagggcattgtgccgctggacatgccgattgacgtggcgcgctattatccgttcatcgtcgacatgggcgggagctactacaacaaggccacgaaccaggccaccttcaccaacaaggcgaacgtcgcgggcctcacgtggtttatgaaagagatggaaagcggcaacttcgtgaccccgcaagaccaaggcgggtcctgggcgggtgtcccgttcgcagagggcaaggcggcgatggcccttgagggcgcttggattgtgccgttcatgcagcagaccgcgccgaagatgaagtacggcattgcggacttcccgtcgctcaacgggcacgatgcgaacatgatttttacggtcgcgtacgagatgtcgaagtacgcgaagaacccggatgctgccgcgaagttgctcttcttcatgacgggcaaagaggcgctcaagatgacggccgattcgggcctcgccattccctctcggaccagcgagcagggcgagtttctgaagaagtatccgtcgtacaagggcttcgtggacggtctcaagggcgccattccgtatcagttcggcacgctcgggcagaacttcctcgacgccatcaacaatgccacgcaacaaggcattctgaagaaggagtcggcgcagcaagtcttgagtcaggcgcagcagacgctcgcttcacagatgaacgactga

SEQ ID NO: 474 - DNA, 1314 bp, Artificial
  Substituion in SEQ ID NO 461
atggagacaagcggggtcaaaccgattgggtgggaggtcgaacgaaagatgaggaaaccatttcttgggatcgcgggtgcggcagtggtcgcgatgggcgcggtgacggcatgcggccaggcgcagagcgcgccctccaaccaggcgaacgtcggcagcgcgtcggcggcgcccattcatctgacgcttggcatgtgggcgtcgagcccggcggaaaagcagctcgtggagcgtcagattgccttgtttgagaaggaaaatccgaacatcaaggtgagcatccaggtcatcacgggcaactacctgcaggcgctgcagccgatgctcgccgcgcacgacgcgccggacatcttctacgtggattcgtcctacgcgccgacgctcgaggcttcgggcgccatcatgccgctcgacagcttcatcaagcaggatcatgtcgatttgtccgacttccagaagaacctgctcgacgcgttcacctggcaggggcacatctacggcctgccgaaggacatgaacacgatggccttggagtacaacccggcgctcctcgccaaggcgggcatccagtcgccgccgaagacgttcgcgcagtttgaccaggaagccgcgaagctcaaggccaagggcattgtgccgctggacatgccgattgacgtggcgcgctattatccgttcatcgtcgacatgggcgggagctactacaacaaggccacgaaccaggccaccttcaccaacaaggcgaacgtcgcgggcctcacgtggtttatgaaagagatggaaagcggcaacttcgtgaccccgcaagaccaaggcgggtcctgggcgggtgtcccgttcgcagagggcaaggcggcgatggcccttgagggcgcttggattgtgccgttcatgcagcagaccgcgccgaagatgaagtacggcattgcggacttcccgtcgctcaacgggcacgatgcgaacatgctgtttacggtcgcgtacgagatgtcgaagtacgcgaagaacccggatgctgccgcgaagttgctcttcttcatgacgggcaaagaggcgctcaagatgacggccgattcgggcctcgccattccctctcggaccagcgagcagggcgagtttctgaagaagtatccgtcgtacaagggcttcgtggacggtctcaagggcgccattccgtatcagttcggcacgctcgggcagaacttcctcgacgccatcaacaatgccacgcaacaaggcattctgaagaaggagtcggcgcagcaagtcttgagtcaggcgcagcagacgctcgcttcacagatgaacgactga

SEQ ID NO: 475 - DNA, 1314 bp, Artificial
  Substituion in SEQ ID NO 461
atggagacaagcggggtcaaaccgattgggtgggaggtcgaacgaaagatgaggcgtccatttcttgggatcgcgggtgcggcagtggtcgcgatgggcgcggtgacggcatgcggccaggcgcagagcgcgccctccaaccaggcgaacgtcggcagcgcgtcggcggcgcccattcatctgacgcttggcatgtgggcgtcgagcccggcggaaaagcagctcgtggagcgtcagattgccttgtttgagaaggaaaatccgaacatcaaggtgagcatccaggtcatcacgggcaactacctgcaggcgctgcagccgatgctcgccgcgcacgacgcgccggacatcttctacgtggattcgtcctacgcgccgacgctcgaggcttcgggcgccatcatgccgctcgacagcttcatcaagcaggatcatgtcgatttgtccgacttccagaagaacctgctcgacgcgttcacctggcaggggcacatctacggcctgccgaaggacatgaacacgatggccttggagtacaacccggcgctcctcgccaaggcgggcatccagtcgccgccgaagacgttcgcgcagtttgaccaggacgccgcgaagctcaaggccaagggcattgtgccgctggacatgccgattgacgtggcgcgctattatccgttcatcgtcgacatgggcgggagctactacaacaaggccacgaaccaggccaccttcaccaacaaggcgaacgtcgcgggcctcacgtggtttatgaaagagatggaaagcggcaacttcgtgaccccgcaagaccaaggcgggtcctgggcgggtgtcccgttcgcagagggcaaggcggcgatggcccttgagggcgcttggattgtgccgttcatgcagcagaccgcgccgaagatgaagtacggcattgcggacttcccgtcgctcaacgggcacgatgcgaacatgctgtttacggtcgcgtacgagatgtcgaagtacgcgaagaacccggatgctgccgcgaagttgctcttcttcatgacgggcaaagaggcgctcaagatgacggccgattcgggcctcgccattccctctcggaccagcgagcagggcgagtttctgaagaagtatccgtcgtacaagggcttcgtggacggtctcaagggcgccattccgtatcagttcggcacgctcgggcagaacttcctcgacgccatcaacaatgccacgcaacaaggcattctgaagaaggagtcggcgcagcaagtcttgagtcaggcgcagcagacgctcgcttcacagatgaacgactga

SEQ ID NO: 476 - DNA, 1314 bp, Artificial
  Substituion in SEQ ID NO 461
atggagacaagcggggtcaaaccgattgggtgggaggtcgaacgaaagatgaggaaaccatttcttgggatcgcgggtgcggcagtggtcgcgatgggcgcggtgacggcatgcggccaggcgcagagcgcgccctccaaccaggcgaacgtcggcagcgcgtcggcggcgcccattcatctgacgcttggcatgtgggcgtcgagcccggcggaaaagcagctcgtggagcgtcagattgccttgtttgagaaggaaaatccgaacttaaaggtgagcatccaggtcatcacgggcaactacctgcaggcgctgcagccgatgctcgccgcgcacgacgcgccggacatcttctacgtggattcgtcctacgcgccgacgctcgaggcttcgggcgccatcatgccgctcgacagcttcatcaagcaggatcatgtcgatttgtccgacttccagaagaacctgctcgacgcgttcacctggcaggggcacatctacggcctgccgaaggacatgaacacgatggccttggagtacaacccggcgctcctcgccaaggcgggcatccagtcgccgccgaagacgttcgcgcagtttgaccaggacgccgcgaagctcaaggccaagggcattgtgccgctggacatgccgattgacgtggcgcgctattatccgttcatcgtcgacatgggcgggagctactacaacaaggccacgaaccaggccaccttcaccaacaaggcgaacgtcgcgggcctcacgtggtttatgaaagagatggaaagcggcaacttcgtgaccccgcaagaccaaggcgggtcctgggcgggtgtcccgttcgcagagggcaaggcggcgatggcccttgagggcgcttggattgtgccgttcatgcagcagaccgcgccgaagatgaagtacggcattgcggacttcccgtcgctcaacgggcacgatgcgaacatgctgtttacggtcgcgtacgagatgtcgaagtacgcgaagaacccggatgctgccgcgaagttgctcttcttcatgacgggcaaagaggcgctcaagatgacggccgattcgggcctcgccattccctctcggaccagcgagcagggcgagtttctgaagaagtatccgtcgtacaagggcttcgtggacggtctcaagggcgccattccgtatcagttcggcacgctcgggcagaacttcctcgacgccatcaacaatgccacgcaacaaggcattctgaagaaggagtcggcgcagcaagtcttgagtcaggcgcagcagacgctcgcttcacagatgaacgactga

SEQ ID NO: 477 - protein, 310 aa, Alicyclobacillus acidocaldarius
MSVANSAAERVTGRGRRIRWNVVEQALAGYLFILPAIVELAVFLLGPIVYAFVISFKHFSYLDPLNSHFVGFLNYIHLFEDPVFLRALWNTTVYALVVVPVQTAIAMMLAVIVNRIRGKTIFRVIYYLPSITSTVGVAVIFSFLFQPNGLLNRLLWILFHIQGPDYFNSPIFAFPAIMAVAVWTTAGQFMVIYLAALQEIPEELYEAAAIDGAEGFAMLRYITIPSLRRTTFLVVVLGMIGAFQVFDLVYVISSASSLPQQYTMTVVLDLFEKGFRTMQMGYASAMGFVLFAIILVLTLIQQLWLGREDA

SEQ ID NO: 478 - DNA, 933 bp, Alicyclobacillus acidocaldarius
atgagcgtcgcaaactccgctgccgagcgggtcacggggcgcgggaggcgcatccgatggaacgtggtggaacaggcgctcgccggttacctgttcattctccccgccatcgtggagttggccgtttttctcctggggcccatcgtgtacgcctttgtcatcagtttcaagcacttttcgtatctggatcccctaaactcgcacttcgtggggttcttgaactacattcacctcttcgaggatccggtgtttctgcgggcgctgtggaacaccacggtgtacgccctcgtggtggtgccggtgcagactgcgatcgccatgatgctggccgtgatcgtcaaccgtatccgcggaaagacgatcttccgggtcatctactacctgccgtcgatcacgtcgaccgtcggcgtggccgtgatcttcagcttcctgttccagccgaacggactgttgaaccgcctgctgtggatcctgtttcacatccaggggcccgactacttcaacagccccatcttcgcgtttccggccatcatggcggtcgccgtgtggaccacggcaggccagttcatggtcatctatctcgcggcgctgcaggagattccggaggagctgtacgaggccgcggccatcgacggggcggaagggttcgccatgttgcgctacatcaccatcccgtcgcttcggcggaccacgtttctcgtcgtggtgctcggtatgattggcgcgttccaggtgttcgatctcgtctacgtcatttcgagcgccagctcgcttccgcagcagtacacgatgaccgttgtgctcgatctgttcgaaaagggcttccgcaccatgcagatgggctacgcgtccgccatgggcttcgtgctgtttgccattattttggtcctgacgctgattcagcagctgtggctcggaagggaggacgcatga

SEQ ID NO: 479 - protein, 278 aa, Thermoanaerobacter pseudethanolicus ATCC 33223
EALSGYAFVLPFIASISIFLIGPLIYAFIISFKEFSFLNPEASRWIGFANYIKLFSDPTFKRALLNTTLYSLGVVPTQLVIALILALIVNSDIKGKTFFRVAYYIPTVTSTVAVSVIFLYLFKADGLVNALLAKFGIQGPTWFNDVRFALPSIMMMAIWSSVGNYMVIFLAGLQDIPSELYEAAEVDGANKFQRFFKITLPMLRPIVFFNLVMSLIGTFQVFDQAYVVSQGTGGPLDATMTVVLDIYRTGFRDFNMGYASAMAFVLFVIILILTLIQR

SEQ ID NO: 480 - protein, 278 aa, Thermoanaerobacter sp. X514
EALSGYAFALPFIASISIFLIGPLIYAFIISFKEFSFLNPEASRWVGFANYTKLFSDPTFKRALLNTTLYSLGVVPTQLIIALILALIVNSDIKGKTFFRVAYYIPTVTSTVAVSVIFLYLFKADGLVNALLAKFGIQGPTWFNDVRFALPSIMMMAIWSSVGNYMVIFLAGLQDIPSELYEAAEVDGANKFQRFFKITLPMLRPIVFFNLVMSLIGTFQVFDQAYVVSQGTGGPLDATMTVVLNIYRTGFRDFNMGYASAMAFVLFVIILILTLIQR

SEQ ID NO: 481 - protein, 286 aa, Thermoanaerobacter tengcongensis MB4
IYEALTGYIFVLPFIASISIFLIGPLIYAFIISFKEFSFLNPAASKWVGLANYINLFSDPTFKKALLNTTLYSLGVVPTQLIIALILALIVNSDIKGKTFFRVAYYIPTITSMVAVSVIFLYLFKTDGLVNMILAKFGIQGPTWFNDVRFALPSIMMMAVWSSVGNYMVIFLAGLQDIPAELYEAAEVDGANKLQKFFNITLPMLRPVVFFNLVISLIGTFQVFDQAYVVSRGTGGPLDATMTMVLYIYRTGFRDFNMGYASAMAFVLFVIILILTLIQRMFFKEE

SEQ ID NO: 482 - protein, 288 aa, Bacillus sp. NRRL B-14911
LREAGQGYLFMSPTLFVLLTFILGPIIYAIFLAFNKVQLLGAVNYDFVGFQNFVRLVDDSRAHIALWNTAKYVFIVVPVQTFLALVLAASLNAGLKGEKFFRIIYFLPTLTSSAVLTLIFMWMYNQNGLINKIFETVGLPTYNWIGDPSIALNSIMIMNIWSTAPFFMVIYLAALQGIPDSLYEAADLDGANAIQKFFFITVPNLRPVTSFVVIMGIIGTFQLFDQSYIFSGGSGGPNNSTLTVVLLIYQYAFKNLGTMGYAAALAFALAVIILAATLLQRRFSKEEN

SEQ ID NO: 483 - protein, 286 aa, Caldicellulosiruptor saccharolyticus DSM 8903
VQEYFTAFVMLLPYIISFFMFFAYPLAKAFIISFQEFSFLGDIPPKFVGLLNYKEALTNKMFLDSIVNTFYYSILVVPTQLIIALILAVIVNDKVKFKDFFRTTYYLPTVTSPVAVSIIFLFLYKTDGLVNQILSHIGITPRNWFNEPSFVMPAIVSVAVWGSVGFYMVTFLSGLSTIPDQLYEAAEVEGAGEFTKLIKITIPLLKPMIFFNTVVSFISTLQMFDLSYIIGGSDGGPMGKAMTMVVMIYRTAFKEFNMGVASAMAFIVFGIIFILTLVQRKFFGEE

SEQ ID NO: 484 - protein, 310 aa, Artificial
  Substituion in SEQ ID NO 477
MSVANSAAERITGRGRRIRWNVVEQALAGYLFILPAIVELAVFLLGPIVYAFVISFKHFSYLDPLNSHFVGFLNYIHLFEDPVFLRALWNTTVYALVVVPVQTAIAMMLAVIVNRIRGKTIFRVIYYLPSITSTVGVAVIFSFLFQPNGLLNRLLWILFHIQGPDYFNSPIFAFPAIMAVAVWTTAGQFMVIYLAALQEIPEELYEAAAIDGAEGFAMLRYITIPSLRRTTFLVVVLGMIGAFQVFDLVYVISSASSLPQQYTMTVVLDLFEKGFRTMQMGYASAMGFVLFAIILVLTLIQQLWLGREDA

SEQ ID NO: 485 - protein, 310 aa, Artificial
  Substituion in SEQ ID NO 477
MSVANSAAERVTGRGRRIRWNVIEQALAGYLFILPAIVELAVFLLGPIVYAFVISFKHFSYLDPLNSHFVGFLNYIHLFEDPVFLRALWNTTVYALVVVPVQTAIAMMLAVIVNRIRGKTIFRVIYYLPSITSTVGVAVIFSFLFQPNGLLNRLLWILFHIQGPDYFNSPIFAFPAIMAVAVWTTAGQFMVIYLAALQEIPEELYEAAAIDGAEGFAMLRYITIPSLRRTTFLVVVLGMIGAFQVFDLVYVISSASSLPQQYTMTVVLDLFEKGFRTMQMGYASAMGFVLFAIILVLTLIQQLWLGREDA

SEQ ID NO: 486 - protein, 310 aa, Artificial
  Substituion in SEQ ID NO 477
MSVANSAAERVTGRGKRIRWNVVEQALAGYLFILPAIVELAVFLLGPIVYAFVISFKHFSYLDPLNSHFVGFLNYIHLFEDPVFLRALWNTTVYALVVVPVQTAIAMMLAVIVNRIRGKTIFRVIYYLPSITSTVGVAVIFSFLFQPNGLLNRLLWILFHIQGPDYFNSPIFAFPAIMAVAVWTTAGQFMVIYLAALQEIPEELYEAAAIDGAEGFAMLRYITIPSLRRTTFLVVVLGMIGAFQVFDLVYVISSASSLPQQYTMTVVLDLFEKGFRTMQMGYASAMGFVLFAIILVLTLIQQLWLGREDA

SEQ ID NO: 487 - protein, 310 aa, Artificial
  Substituion in SEQ ID NO 477
MSVANSAAERVTGRGRRIRWNVVEQALAGYLFILPAIVELAVFLLGPIVYAFVISFKHFSYLDPLNSHFVGFLNYIHLFEDPVFLRALWNTTVYALVVVPVQTAIAMMLAVIVNRIRGKTIFRVIYYLPSITSTVGVAVIFSFLFQPNGLLNRLLWILFHIQGPDYFNSPIFAFPAIMAVAVWTTAGQFMVIYLAALQEIPDELYEAAAIDGAEGFAMLRYITIPSLRRTTFLVVVLGMIGAFQVFDLVYVISSASSLPQQYTMTVVLDLFEKGFRTMQMGYASAMGFVLFAIILVLTLIQQLWLGREDA

SEQ ID NO: 488 - protein, 310 aa, Artificial
  Substituion in SEQ ID NO 477
MSVANSAAERVTGRGRKIRWNVVEQALAGYLFILPAIVELAVFLLGPIVYAFVISFKHFSYLDPLNSHFVGFLNYIHLFEDPVFLRALWNTTVYALVVVPVQTAIAMMLAVIVNRIRGKTIFRVIYYLPSITSTVGVAVIFSFLFQPNGLLNRLLWILFHIQGPDYFNSPIFAFPAIMAVAVWTTAGQFMVIYLAALQEIPEELYEAAAIDGAEGFAMLRYITIPSLRRTTFLVVVLGMIGAFQVFDLVYVISSASSLPQQYTMTVVLDLFEKGFRTMQMGYASAMGFVLFAIILVLTLIQQLWLGREDA

SEQ ID NO: 489 - DNA, 933 bp, Artificial
  Substituion in SEQ ID NO 478
atgagcgtcgcaaactccgctgccgagcggattacggggcgcgggaggcgcatccgatggaacgtggtggaacaggcgctcgccggttacctgttcattctccccgccatcgtggagttggccgtttttctcctggggcccatcgtgtacgcctttgtcatcagtttcaagcacttttcgtatctggatcccctaaactcgcacttcgtggggttcttgaactacattcacctcttcgaggatccggtgtttctgcgggcgctgtggaacaccacggtgtacgccctcgtggtggtgccggtgcagactgcgatcgccatgatgctggccgtgatcgtcaaccgtatccgcggaaagacgatcttccgggtcatctactacctgccgtcgatcacgtcgaccgtcggcgtggccgtgatcttcagcttcctgttccagccgaacggactgttgaaccgcctgctgtggatcctgtttcacatccaggggcccgactacttcaacagccccatcttcgcgtttccggccatcatggcggtcgccgtgtggaccacggcaggccagttcatggtcatctatctcgcggcgctgcaggagattccggaggagctgtacgaggccgcggccatcgacggggcggaagggttcgccatgttgcgctacatcaccatcccgtcgcttcggcggaccacgtttctcgtcgtggtgctcggtatgattggcgcgttccaggtgttcgatctcgtctacgtcatttcgagcgccagctcgcttccgcagcagtacacgatgaccgttgtgctcgatctgttcgaaaagggcttccgcaccatgcagatgggctacgcgtccgccatgggcttcgtgctgtttgccattattttggtcctgacgctgattcagcagctgtggctcggaagggaggacgcatga

SEQ ID NO: 490 - DNA, 933 bp, Artificial
  Substituion in SEQ ID NO 478
atgagcgtcgcaaactccgctgccgagcgggtcacggggcgcgggaggcgcatccgatggaacgtgattgaacaggcgctcgccggttacctgttcattctccccgccatcgtggagttggccgtttttctcctggggcccatcgtgtacgcctttgtcatcagtttcaagcacttttcgtatctggatcccctaaactcgcacttcgtggggttcttgaactacattcacctcttcgaggatccggtgtttctgcgggcgctgtggaacaccacggtgtacgccctcgtggtggtgccggtgcagactgcgatcgccatgatgctggccgtgatcgtcaaccgtatccgcggaaagacgatcttccgggtcatctactacctgccgtcgatcacgtcgaccgtcggcgtggccgtgatcttcagcttcctgttccagccgaacggactgttgaaccgcctgctgtggatcctgtttcacatccaggggcccgactacttcaacagccccatcttcgcgtttccggccatcatggcggtcgccgtgtggaccacggcaggccagttcatggtcatctatctcgcggcgctgcaggagattccggaggagctgtacgaggccgcggccatcgacggggcggaagggttcgccatgttgcgctacatcaccatcccgtcgcttcggcggaccacgtttctcgtcgtggtgctcggtatgattggcgcgttccaggtgttcgatctcgtctacgtcatttcgagcgccagctcgcttccgcagcagtacacgatgaccgttgtgctcgatctgttcgaaaagggcttccgcaccatgcagatgggctacgcgtccgccatgggcttcgtgctgtttgccattattttggtcctgacgctgattcagcagctgtggctcggaagggaggacgcatga

SEQ ID NO: 491 - DNA, 933 bp, Artificial
  Substituion in SEQ ID NO 478
atgagcgtcgcaaactccgctgccgagcgggtcacggggcgcgggaaacgcatccgatggaacgtggtggaacaggcgctcgccggttacctgttcattctccccgccatcgtggagttggccgtttttctcctggggcccatcgtgtacgcctttgtcatcagtttcaagcacttttcgtatctggatcccctaaactcgcacttcgtggggttcttgaactacattcacctcttcgaggatccggtgtttctgcgggcgctgtggaacaccacggtgtacgccctcgtggtggtgccggtgcagactgcgatcgccatgatgctggccgtgatcgtcaaccgtatccgcggaaagacgatcttccgggtcatctactacctgccgtcgatcacgtcgaccgtcggcgtggccgtgatcttcagcttcctgttccagccgaacggactgttgaaccgcctgctgtggatcctgtttcacatccaggggcccgactacttcaacagccccatcttcgcgtttccggccatcatggcggtcgccgtgtggaccacggcaggccagttcatggtcatctatctcgcggcgctgcaggagattccggaggagctgtacgaggccgcggccatcgacggggcggaagggttcgccatgttgcgctacatcaccatcccgtcgcttcggcggaccacgtttctcgtcgtggtgctcggtatgattggcgcgttccaggtgttcgatctcgtctacgtcatttcgagcgccagctcgcttccgcagcagtacacgatgaccgttgtgctcgatctgttcgaaaagggcttccgcaccatgcagatgggctacgcgtccgccatgggcttcgtgctgtttgccattattttggtcctgacgctgattcagcagctgtggctcggaagggaggacgcatga

SEQ ID NO: 492 - DNA, 933 bp, Artificial
  Substituion in SEQ ID NO 478
atgagcgtcgcaaactccgctgccgagcgggtcacggggcgcgggaggcgcatccgatggaacgtggtggaacaggcgctcgccggttacctgttcattctccccgccatcgtggagttggccgtttttctcctggggcccatcgtgtacgcctttgtcatcagtttcaagcacttttcgtatctggatcccctaaactcgcacttcgtggggttcttgaactacattcacctcttcgaggatccggtgtttctgcgggcgctgtggaacaccacggtgtacgccctcgtggtggtgccggtgcagactgcgatcgccatgatgctggccgtgatcgtcaaccgtatccgcggaaagacgatcttccgggtcatctactacctgccgtcgatcacgtcgaccgtcggcgtggccgtgatcttcagcttcctgttccagccgaacggactgttgaaccgcctgctgtggatcctgtttcacatccaggggcccgactacttcaacagccccatcttcgcgtttccggccatcatggcggtcgccgtgtggaccacggcaggccagttcatggtcatctatctcgcggcgctgcaggagattccggatgagctgtacgaggccgcggccatcgacggggcggaagggttcgccatgttgcgctacatcaccatcccgtcgcttcggcggaccacgtttctcgtcgtggtgctcggtatgattggcgcgttccaggtgttcgatctcgtctacgtcatttcgagcgccagctcgcttccgcagcagtacacgatgaccgttgtgctcgatctgttcgaaaagggcttccgcaccatgcagatgggctacgcgtccgccatgggcttcgtgctgtttgccattattttggtcctgacgctgattcagcagctgtggctcggaagggaggacgcatga

SEQ ID NO: 493 - DNA, 933 bp, Artificial
  Substituion in SEQ ID NO 478
atgagcgtcgcaaactccgctgccgagcgggtcacggggcgcgggaggaaaatccgatggaacgtggtggaacaggcgctcgccggttacctgttcattctccccgccatcgtggagttggccgtttttctcctggggcccatcgtgtacgcctttgtcatcagtttcaagcacttttcgtatctggatcccctaaactcgcacttcgtggggttcttgaactacattcacctcttcgaggatccggtgtttctgcgggcgctgtggaacaccacggtgtacgccctcgtggtggtgccggtgcagactgcgatcgccatgatgctggccgtgatcgtcaaccgtatccgcggaaagacgatcttccgggtcatctactacctgccgtcgatcacgtcgaccgtcggcgtggccgtgatcttcagcttcctgttccagccgaacggactgttgaaccgcctgctgtggatcctgtttcacatccaggggcccgactacttcaacagccccatcttcgcgtttccggccatcatggcggtcgccgtgtggaccacggcaggccagttcatggtcatctatctcgcggcgctgcaggagattccggaggagctgtacgaggccgcggccatcgacggggcggaagggttcgccatgttgcgctacatcaccatcccgtcgcttcggcggaccacgtttctcgtcgtggtgctcggtatgattggcgcgttccaggtgttcgatctcgtctacgtcatttcgagcgccagctcgcttccgcagcagtacacgatgaccgttgtgctcgatctgttcgaaaagggcttccgcaccatgcagatgggctacgcgtccgccatgggcttcgtgctgtttgccattattttggtcctgacgctgattcagcagctgtggctcggaagggaggacgcatga

SEQ ID NO: 494 - protein, 280 aa, Alicyclobacillus acidocaldarius
MRMATSAPSPSWRRAGLWMYVIAVIYAAISLVPFLWSIYTSVKPTSEVFQLFVPWRTLTLSSYTSILQNFPFGRWFLNSAIVAFIVTVGNLVVNTFAGYAFARLRFPGRGFLFYVFLGVMMIPGQVVLVPIYMLLARLGWIDTYVGLTVPFLLSSTMVFLSRQFFLGIPKELEEAARIDGIGYFGMFFRIMLPLARPLLAAQTILTFQGNWNSFLWPLLIGQTTNMYTLPVGLNSFYGQYNAYWNSVMAGMVLLTVPMMVVFIIFQRQFIQGVSQAGLKG

SEQ ID NO: 495 - DNA, 843 bp, Alicyclobacillus acidocaldarius
atgcgcatggccacatccgcaccatccccgtcctggcgccgcgccggcctgtggatgtacgtgattgccgtgatctacgcggccatttcgctggtgccctttctgtggtccatctacacgtcggtcaagccgacgtccgaggtgtttcaactcttcgtgccctggcggaccctgacgctgtcgagctacacctccatcctgcagaacttcccgtttgggcgctggtttttgaacagcgccatcgtggcgttcatcgtgaccgtgggaaacctggtggtgaacacgtttgcgggctacgcgtttgcgcggcttcgtttcccgggccggggctttttgttttacgtcttcctcggcgtcatgatgatcccaggacaggtggtcttggttcccatttacatgctgctcgcgcgcctcggctggatcgacacctacgtcgggctcaccgtgccgttcttgctgagttccaccatggtgtttttgtcgcgccagtttttcctcggcatcccgaaggagctggaggaggcggctcgcatcgacggcatcggatacttcgggatgttctttcgcatcatgctgccgctcgcgcgtccgctcctggccgcgcagaccattctgacgttccagggcaactggaactcgtttctctggccgcttctcatcggtcagacgacgaacatgtacacgttgccggtggggctgaactcgttttatggccagtacaacgcgtactggaacagcgtgatggcgggcatggtcctgctgacggttcccatgatggttgtgttcatcatctttcagcgccaattcattcagggcgtgtcccaagcaggactcaaaggctga

SEQ ID NO: 496 - protein, 260 aa, Thermoanaerobacter tengcongensis MB4
YMVLIGYAAITLGPFIWSIITSLKPTSELNTFAVNIKHLTLDNYKMIITKFPFLRWFINSAIVAAIVTFGNMLFNSMAGYALARINFPGRNFLFLLVLALMMIPGQVVMVPTYILLSKLGWVNTYMGLTIPFLTSNFGIFLMRQFFLTIPRELEEAATIDGMSRFGIFFKIVLPLAKPALATQFIFMFTGNWNSFLWPSLLTSSDDMYTLPVGLNSFYGQYYQFWNQVMAGAILLTLPTIVIFLIFQRYFVRGIATTGLK

SEQ ID NO: 497 - protein, 260 aa, Thermoanaerobacter pseudethanolicus ATCC 33223
YTVVVGYAVITLGPFIWSIITSLKPTSELNTFAVNIKHLTLDNYKMIITKFPFLRWFINSAIVAVIVTLGNILFNSMAGYALARINFPGRNLLFMVVLALMMVPGQVVMVPTYILLSKLGWVNTYMGLTIPFLTSNFGIFLMRQFFLSLPKELEEAATIDGLSRFGIFFKIVLPLSKPALATQFIFMFTGNWNSFLWPSLLTSSDDMYTLPVGLNSFYGQYYQFWNQVMAGAILLTLPTILIFLIFQRYFVKGISTTGLK

SEQ ID NO: 498 - protein, 260 aa, Thermoanaerobacter sp. X514
YTVVVGYAVITLGPFIWSIITSLKPTSELNTFVVNIKHLTLDNYKMIITKFPFLRWFINSAIVAAIVTFGNMLFNSMAGYALARINFPGRNLLFMVVLALMMVPGQVVMVPTYILLSKLGWVNTYMGLTIPFLTSNFGIFLMRQFFLSLPKELEEAATIDGLSRFGIFFKIVLPLSKPALATQFIFMFTGNWNSFLWPSLLTSSDDMYTLPVGLNSFYGQYYQFWNQVMAGAILLTLPTILIFLIFQRYFVKGISTTGLK

SEQ ID NO: 499 - protein, 260 aa, Caldicellulosiruptor saccharolyticus DSM 8903
YSICILWTLVTLIPYLIAVITSLKPVEDVTKFSIDFSKLTFDSYRYITHEFPFLRWLFNSFVVAVAVTTGNILFNSMAAYALARLDFPFKKVVFYVIIGTMMIPGQVLLIPIYLILNRLGWIDSYKGLIIPWLVSAFYIFFMRQYFLTIPKDLEEAALIDGLSRFGIFFKIFLPLSLPALATQAIFIFVGNWNSFMWPSIIASSEDLYTLPVGLNSFYGQYYQFWNQVLAGAILLSLPTIIVFVLFQKYFVKGIVTSGLK

SEQ ID NO: 500 - protein, 264 aa, Geobacillus thermodenitrificans NG80-2
LYVVLVMYAIITLIPFLWALSSSFKTLEEIVSGTMSFVPKQFTLDNYKQIFVEQDLFPRWLLNSVIIAVAVTILNLLFNSMAGYALARLQFPGRKPLFLIILAVLMIPAQVTMIPNYLILKQLGWLNSYQGMIVPTMINATFIFMMRQFFINFPKELEEAAELDGLGRFGIFFRIVLPLARPALAAQAIFVFMGSWNDFMRPLIILSDPQLFTLPLGLNSFKGQYISYWNYIMAASMVFTLPVLVIYAFFNRYFIKGISFTGGK

SEQ ID NO: 501 - protein, 280 aa, Artificial
  Substituion in SEQ ID NO 494
MRMATSAPSPSWRRAGLWMYVIAVIYAAISLVPFLWSIYTSVKPTSEVFQLFVPWRTLTLSSYTSILQNFPFGRWFLNSAIVAFIVTVGNLVVNTFAGYAFARLKFPGRGFLFYVFLGVMMIPGQVVLVPIYMLLARLGWIDTYVGLTVPFLLSSTMVFLSRQFFLGIPKELEEAARIDGIGYFGMFFRIMLPLARPLLAAQTILTFQGNWNSFLWPLLIGQTTNMYTLPVGLNSFYGQYNAYWNSVMAGMVLLTVPMMVVFIIFQRQFIQGVSQAGLKG

SEQ ID NO: 502 - protein, 280 aa, Artificial
  Substituion in SEQ ID NO 494
MRMATSAPSPSWRRAGLWMYVIAVIYAAISLVPFLWSIYTSVKPTSEVFQLFVPWRTLTISSYTSILQNFPFGRWFLNSAIVAFIVTVGNLVVNTFAGYAFARLRFPGRGFLFYVFLGVMMIPGQVVLVPIYMLLARLGWIDTYVGLTVPFLLSSTMVFLSRQFFLGIPKELEEAARIDGIGYFGMFFRIMLPLARPLLAAQTILTFQGNWNSFLWPLLIGQTTNMYTLPVGLNSFYGQYNAYWNSVMAGMVLLTVPMMVVFIIFQRQFIQGVSQAGLKG

SEQ ID NO: 503 - protein, 280 aa, Artificial
  Substituion in SEQ ID NO 494
MRMATSAPSPSWRRAGLWMYVIAVIYAAISLVPFLWSIYTSVKPTSEVFQLFVPWRTLTLSSYTSILQNFPFGRWFLNSAIVAFIVTVGNLVVNTFAGYAFARLRFPGRGFLFYVFLGVMMIPGQVVLVPIYMILARLGWIDTYVGLTVPFLLSSTMVFLSRQFFLGIPKELEEAARIDGIGYFGMFFRIMLPLARPLLAAQTILTFQGNWNSFLWPLLIGQTTNMYTLPVGLNSFYGQYNAYWNSVMAGMVLLTVPMMVVFIIFQRQFIQGVSQAGLKG

SEQ ID NO: 504 - protein, 280 aa, Artificial
  Substituion in SEQ ID NO 494
MRMATSAPSPSWRRAGLWMYVIAVIYAAISLVPFLWSIYTSVKPTSEVFQLFVPWRTLTLSSYTSILQNFPFGRWFLNSAIVAFIVTVGNLVVNTFAGYAFARLRFPGRGFLFYVFLGVMMIPGQVVLVPLYMLLARLGWIDTYVGLTVPFLLSSTMVFLSRQFFLGIPKELEEAARIDGIGYFGMFFRIMLPLARPLLAAQTILTFQGNWNSFLWPLLIGQTTNMYTLPVGLNSFYGQYNAYWNSVMAGMVLLTVPMMVVFIIFQRQFIQGVSQAGLKG

SEQ ID NO: 505 - protein, 280 aa, Artificial
  Substituion in SEQ ID NO 494
MRMATSAPSPSWRRAGLWMYVIAVIYAAISLVPFIWSIYTSVKPTSEVFQLFVPWRTLTLSSYTSILQNFPFGRWFLNSAIVAFIVTVGNLVVNTFAGYAFARLRFPGRGFLFYVFLGVMMIPGQVVLVPIYMLLARLGWIDTYVGLTVPFLLSSTMVFLSRQFFLGIPKELEEAARIDGIGYFGMFFRIMLPLARPLLAAQTILTFQGNWNSFLWPLLIGQTTNMYTLPVGLNSFYGQYNAYWNSVMAGMVLLTVPMMVVFIIFQRQFIQGVSQAGLKG

SEQ ID NO: 506 - DNA, 843 bp, Artificial
  Substituion in SEQ ID NO 495
atgcgcatggccacatccgcaccatccccgtcctggcgccgcgccggcctgtggatgtacgtgattgccgtgatctacgcggccatttcgctggtgccctttctgtggtccatctacacgtcggtcaagccgacgtccgaggtgtttcaactcttcgtgccctggcggaccctgacgctgtcgagctacacctccatcctgcagaacttcccgtttgggcgctggtttttgaacagcgccatcgtggcgttcatcgtgaccgtgggaaacctggtggtgaacacgtttgcgggctacgcgtttgcgcggcttaaattcccgggccggggctttttgttttacgtcttcctcggcgtcatgatgatcccaggacaggtggtcttggttcccatttacatgctgctcgcgcgcctcggctggatcgacacctacgtcgggctcaccgtgccgttcttgctgagttccaccatggtgtttttgtcgcgccagtttttcctcggcatcccgaaggagctggaggaggcggctcgcatcgacggcatcggatacttcgggatgttctttcgcatcatgctgccgctcgcgcgtccgctcctggccgcgcagaccattctgacgttccagggcaactggaactcgtttctctggccgcttctcatcggtcagacgacgaacatgtacacgttgccggtggggctgaactcgttttatggccagtacaacgcgtactggaacagcgtgatggcgggcatggtcctgctgacggttcccatgatggttgtgttcatcatctttcagcgccaattcattcagggcgtgtcccaagcaggactcaaaggctga

SEQ ID NO: 507 - DNA, 843 bp, Artificial
  Substituion in SEQ ID NO 495
atgcgcatggccacatccgcaccatccccgtcctggcgccgcgccggcctgtggatgtacgtgattgccgtgatctacgcggccatttcgctggtgccctttctgtggtccatctacacgtcggtcaagccgacgtccgaggtgtttcaactcttcgtgccctggcggaccctgacgatttcgagctacacctccatcctgcagaacttcccgtttgggcgctggtttttgaacagcgccatcgtggcgttcatcgtgaccgtgggaaacctggtggtgaacacgtttgcgggctacgcgtttgcgcggcttcgtttcccgggccggggctttttgttttacgtcttcctcggcgtcatgatgatcccaggacaggtggtcttggttcccatttacatgctgctcgcgcgcctcggctggatcgacacctacgtcgggctcaccgtgccgttcttgctgagttccaccatggtgtttttgtcgcgccagtttttcctcggcatcccgaaggagctggaggaggcggctcgcatcgacggcatcggatacttcgggatgttctttcgcatcatgctgccgctcgcgcgtccgctcctggccgcgcagaccattctgacgttccagggcaactggaactcgtttctctggccgcttctcatcggtcagacgacgaacatgtacacgttgccggtggggctgaactcgttttatggccagtacaacgcgtactggaacagcgtgatggcgggcatggtcctgctgacggttcccatgatggttgtgttcatcatctttcagcgccaattcattcagggcgtgtcccaagcaggactcaaaggctga

SEQ ID NO: 508 - DNA, 843 bp, Artificial
  Substituion in SEQ ID NO 495
atgcgcatggccacatccgcaccatccccgtcctggcgccgcgccggcctgtggatgtacgtgattgccgtgatctacgcggccatttcgctggtgccctttctgtggtccatctacacgtcggtcaagccgacgtccgaggtgtttcaactcttcgtgccctggcggaccctgacgctgtcgagctacacctccatcctgcagaacttcccgtttgggcgctggtttttgaacagcgccatcgtggcgttcatcgtgaccgtgggaaacctggtggtgaacacgtttgcgggctacgcgtttgcgcggcttcgtttcccgggccggggctttttgttttacgtcttcctcggcgtcatgatgatcccaggacaggtggtcttggttcccatttacatgattctcgcgcgcctcggctggatcgacacctacgtcgggctcaccgtgccgttcttgctgagttccaccatggtgtttttgtcgcgccagtttttcctcggcatcccgaaggagctggaggaggcggctcgcatcgacggcatcggatacttcgggatgttctttcgcatcatgctgccgctcgcgcgtccgctcctggccgcgcagaccattctgacgttccagggcaactggaactcgtttctctggccgcttctcatcggtcagacgacgaacatgtacacgttgccggtggggctgaactcgttttatggccagtacaacgcgtactggaacagcgtgatggcgggcatggtcctgctgacggttcccatgatggttgtgttcatcatctttcagcgccaattcattcagggcgtgtcccaagcaggactcaaaggctga

SEQ ID NO: 509 - DNA, 843 bp, Artificial
  Substituion in SEQ ID NO 495
atgcgcatggccacatccgcaccatccccgtcctggcgccgcgccggcctgtggatgtacgtgattgccgtgatctacgcggccatttcgctggtgccctttctgtggtccatctacacgtcggtcaagccgacgtccgaggtgtttcaactcttcgtgccctggcggaccctgacgctgtcgagctacacctccatcctgcagaacttcccgtttgggcgctggtttttgaacagcgccatcgtggcgttcatcgtgaccgtgggaaacctggtggtgaacacgtttgcgggctacgcgtttgcgcggcttcgtttcccgggccggggctttttgttttacgtcttcctcggcgtcatgatgatcccaggacaggtggtcttggttcccttatacatgctgctcgcgcgcctcggctggatcgacacctacgtcgggctcaccgtgccgttcttgctgagttccaccatggtgtttttgtcgcgccagtttttcctcggcatcccgaaggagctggaggaggcggctcgcatcgacggcatcggatacttcgggatgttctttcgcatcatgctgccgctcgcgcgtccgctcctggccgcgcagaccattctgacgttccagggcaactggaactcgtttctctggccgcttctcatcggtcagacgacgaacatgtacacgttgccggtggggctgaactcgttttatggccagtacaacgcgtactggaacagcgtgatggcgggcatggtcctgctgacggttcccatgatggttgtgttcatcatctttcagcgccaattcattcagggcgtgtcccaagcaggactcaaaggctga

SEQ ID NO: 510 - DNA, 843 bp, Artificial
  Substituion in SEQ ID NO 495
atgcgcatggccacatccgcaccatccccgtcctggcgccgcgccggcctgtggatgtacgtgattgccgtgatctacgcggccatttcgctggtgccctttatttggtccatctacacgtcggtcaagccgacgtccgaggtgtttcaactcttcgtgccctggcggaccctgacgctgtcgagctacacctccatcctgcagaacttcccgtttgggcgctggtttttgaacagcgccatcgtggcgttcatcgtgaccgtgggaaacctggtggtgaacacgtttgcgggctacgcgtttgcgcggcttcgtttcccgggccggggctttttgttttacgtcttcctcggcgtcatgatgatcccaggacaggtggtcttggttcccatttacatgctgctcgcgcgcctcggctggatcgacacctacgtcgggctcaccgtgccgttcttgctgagttccaccatggtgtttttgtcgcgccagtttttcctcggcatcccgaaggagctggaggaggcggctcgcatcgacggcatcggatacttcgggatgttctttcgcatcatgctgccgctcgcgcgtccgctcctggccgcgcagaccattctgacgttccagggcaactggaactcgtttctctggccgcttctcatcggtcagacgacgaacatgtacacgttgccggtggggctgaactcgttttatggccagtacaacgcgtactggaacagcgtgatggcgggcatggtcctgctgacggttcccatgatggttgtgttcatcatctttcagcgccaattcattcagggcgtgtcccaagcaggactcaaaggctga

SEQ ID NO: 511 - protein, 576 aa, Alicyclobacillus acidocaldarius
MQKGERNMKRSKSNRGWVAAAVGLAVVGVAGCGAANTSANGASHSASASPEAASASSSSVLTVAPNVTGTFSDNFNPFSTNSMPGTLGNIYETLFYFDNTTGKQFNLLGTSFHFSNGGKILTVSLRKNAVWTDGVPFTAQDVVFTFEDLKKYPDADTNGVWQQLKSVQADGKYTVVFQFAQPNIPFAEQYVLGGTYIVPAHQWKSLGDPAKAKITHLNAIGTGPFKLSSFTTQDYQFTANPRYYGGAPEVKTLNYPAFASNSSADLALASGQIQYAGINIPNVEKTFVAADPAHNHYLFPPNESVELYPNLHNSLLAMLPVREAISLAIDRDALSKIGETGYEKPAVPTSLVLPPQSSWLDPSLPASDRAFAVNDAKAVQILQKAGFRKDQNGIFALHGKELSFNLLTVSGWSDWDEDALLIKQQLAKVGIAVNVQEEQFSAYYSAIDPGPGQTPHYDLAISWTNVGPTPYTTYYDMLDSHGSFNLEGYRNAQVDQWFNEFSSTTDSQVQHQVMYRIERLVASQLPVIPLLDGALWYEYNDSHFTGFPTANNLWINPAPYTYQAAAIIMDHLKPVK

SEQ ID NO: 512 - DNA, 1731 bp, Alicyclobacillus acidocaldarius
gtgcaaaagggggaacgaaacatgaagcggtcgaagagcaatcgaggatgggtcgccgctgcggtcggtctcgccgtggtgggtgtcgccgggtgcggcgcagcgaacacctcggcgaacggcgccagccattctgcctcggcgtcgccagaggcggcgagcgcgtcgtcgagttcggtcctgaccgtcgcgccgaacgtcacgggcaccttttcggacaacttcaatccgtttagcaccaacagcatgcccggcaccctaggcaacatctacgagacattgttctacttcgacaatacgacagggaaacagttcaacctgttggggacctccttccacttttcgaacggagggaaaatcctgacggtttctctgcgaaaaaacgcggtctggacggacggagtcccgttcacggcgcaggatgttgtcttcacgttcgaggatctcaagaagtatcccgacgcggataccaacggcgtgtggcagcagctgaagagcgtccaggccgacggaaagtacaccgtggtcttccagttcgcgcagcccaacatcccgtttgccgagcagtacgtccttgggggcacgtacattgtgccggctcatcagtggaagtcgcttggcgatccggccaaggccaagatcacgcacttgaacgccattggcacgggtccattcaagctgtcgtcctttacaactcaggactaccaattcaccgcaaatccgcgttactacggaggggcacctgaggtcaagaccctcaattatccggcgttcgccagcaactcgagtgccgatttggcgctcgcgagcggtcagattcaatacgccggcatcaacattcccaatgtcgagaagaccttcgtggcagccgatccggcgcacaaccactatttgttcccgcccaacgaatcggtggagctctatccgaacctgcacaactcgctgctcgccatgctgcctgtgcgcgaggccatcagcctggccatcgatcgcgacgcactctccaaaatcggagagacgggctatgagaagccagccgtgccgacgagtctcgtcttaccgccacagtcgtcgtggttggacccgagtctgcccgcgagcgatcgcgcctttgcggtcaacgatgccaaagcggttcagattttgcagaaggcaggcttccgcaaggaccaaaacgggatttttgcgctccatggcaaggagttgtccttcaacttactcacggtaagcggttggagcgactgggatgaggacgcgctgctcatcaagcagcagttggcgaaggtcgggatcgccgtgaatgtccaggaggagcagttctcggcctactacagcgctatcgatccgggcccgggccagacgccgcactacgacctcgccatctcgtggaccaacgtggggcctacgccgtacacgacgtattacgacatgttggattcgcacggatcctttaatttggaaggctatcgcaatgcgcaggtggatcagtggttcaacgagttttcgtcgaccacggatagccaggttcagcaccaggtgatgtacaggattgagcgactcgtggcgagccaactgccggtcatcccgctgttggatggcgcgctctggtacgagtacaacgacagccacttcacgggcttcccgacggccaacaacctctggatcaatccggcgccgtacacctaccaggcggctgccatcatcatggatcacctgaagccggtgaagtga

SEQ ID NO: 513 - protein, 517 aa, Sorangium cellulosum 'So ce 56'
LTVSIEQQASWVRNFNPLLAPGNVRWPTVAGIYEPLLVYNTMKGEFTPWLASKYEWGNGNKTLTVTTRPGVKWSDGQPFTAKDVAFTFGLLKKHVALDLQGVWKWLTSVEAKSDSTVEFTLTRPYVPGLVFLGHQPIVPEHKWKDVADPVTYTNENPVATGPFTEVKTFQNQIYELGRNPNYWQQGKPAIKGLRFPAYPGNDQANLALLNGEVDWAGNFVPEIEKVYVGKDPANHHYWFPLVGSTVFVYTNTTKKPLDDARVRKAISMSLDREQIVKVAMNNYTRPADATALSDAHERWRSQKTVEAGDWVKFNVAKANQILDEAGYAKGADGIRVKDGKPLRFDLNVVTGWSDWVRAAQIVTQQVKQIGVEATLKTYDFSAFFEALQKGTFDLSMGWSNEEPTPYNFYRDLLGTATAKPVGETSARNWHRFGAKQADGLFEAFEAATEPAEQKKLIEQLQEIFSETAPSIPLFPGPSWGEYNTRRFTGFPSKENPYAKLSPNNPPEYLLVLTELKP

SEQ ID NO: 514 - protein, 518 aa, Sorangium cellulosum 'So ce 56'
MVTISREQQASWVRSFNPLLAEGSVRFPTLAGIYEPMLIFNTMKGEYTPWLATKYAWSDGNKKLTFTTRSGVQWSDGQAFSAKDVVFTFELLKKHAALDLSGVWKFVESVKATDDATVEFALKRPYVPGLSYIGHQPIVPEHKWKDVADPVTYANENPVATGPFTEIKTFQNQVYELGRNPNYWQKGKPAVDGLRFPAYPGNDQVNLAIINGEVDWAGAFVPEIEKVYVAKDPANHHYWFPLVGGMATLYPNSTKKPFDDVRVRKAISMGIDRAQIVKIASNDYTQPADATGLDDSYERWRNPKAVAAGDWVKLDVARAKQLLDEAGYAPGPDGIRVKDGKPMRFEINVVTGWSDWVRAVQIMTQNLKQLGIDASLKAYDFSAFFEALQKGTFDMSMGWTTVEPTPYNYYRDLMSAELVKPVGEASARNWHRYGDKEADKLFQQFEAATESAEQKRILDEVQMLYAQNAPVIPLFKNPSWGEYSTKRFTGFPTKENPYAKLSPNNPPEYLLVLTEIRP

SEQ ID NO: 515 - protein, 517 aa, Sorangium cellulosum 'So ce 56'
VTISREQQASWVRNFNPLLGEGATRFPTVAGIYEPMIVYNTMKGEYVPWLATKYEWSDANKKLTFTTRTEVKWSDGQPFSAKDVAFTFGLLKKFPALDLTGVWKLVDSVEAKNDTTVEFVFKEAFVPGLTYIGHQPIVPEHKWKDVADPVTFTNENPVATGPFTEVKTFQNQIYELGKNPNYWQKGKPAVEGLRFPAYPGNDQANLALINGEVDWAGNFVPDIDKTYVAKDPENNHYWFPLVGGTVTLYPNATKKPFNDIKLRKAISMAIDRAQIAKVAVNGYTVGADGTGLDDAYGRWRSDKAAAAGDWTTFDVAKANALLDEAGYAKGADGIRAKDGKPLKFDINVVTGWSDWVRAVQITTQSLKAVGIEATLKTYDFSAFFEALQKGTFDMSMGWTNTEPTPFNYYRDLMAPEFVKAVGEVSNRNWHRFAAKEAEPLFKKFAAATDPAEQKSIVEDLQMIYATQVPVIPLFKNPSWGEYSTKRFVGWPSKENPYAKLSPNNSPDYLLVLTEIKP

SEQ ID NO: 516 - protein, 504 aa, Thermotoga lettingae TMO
LTMIISVTGAHQRNFNPYFAGGTGYAACGFIYETLIYSNNFTGEIIPWLAVDYEWSNDYRSIVFNLRKNVTWSDGKPFTADDVVFTFEMLRKFPSLDTQGIWSSGLESVEKIDSYTVRLNFSKLNTLIIYNIAGVYMVPKHLWEKLDDPSKFTNENPVGTGAYVLENFTDQVFTLKKRVDYWQAEKVKVDRIRIPAFNGNEPAQLAVANGELDWAGINYPRIENVQNKDIKYWFPEGNPVFLFFNLERDPFKDPAFRKAIARAVNTDELVKIGMTNYAVKANPVLIKSGYSYLIDENLKDKWYSFDIQQAKSELASLGFRAGKDGILVGADGKRLSYELIVPAGWTDWIAVSQLLSQQLKKIGVELNVTPIDFGAYLAKIRQKDFDVAVSWSNYGPNPYIFFQNYLHSSNAYTGSNRGGWINKETDELVEKLSQTADMEEIKTIVSKIQEIILDNVPAVPLFYNPVWFIYSIKNFTGWPNENNAFVEPRTTGMDKIYLIMHLQP

SEQ ID NO: 517 - protein, 518 aa, Sorangium cellulosum 'So ce 56'
VVTIAREQQATWVRNFNPLLPEGSARFPTVAGIYEPMLVYNTMRSDYTPWLATGYAWSDANKKLTFTTRSGVKWSDGQAFTARDVAFTFALLKKHAALDLAGVWRFLGAVTAIDDTTVEFTLRRPYVPGLSYIGHQPIVPEHVWKDVVDPVTFANENPVATGPFTEVKVFQNQVYELGKNPRYWQEGKPAVDGLRFPAYPSNDQVTLALVNGEIDWAGAFVPDIERVFVAKDPAHHHYWFPLVGGTATLYPNATKKPFDDVRVRKAISMAIDRDQIVKLAADNYTHGADATGLDDSYERFRSEKAVEAGDWVKFDPQRANQILDEAGYPRGADGIRTRLGKPMHFEINVVSGWSDWVRAVQIITQNLESVGIAASMKTYDFSAFYAALQKGLFDMSMGWTSVEPTPYNFYRDLMSADLVKPLGEVAPRNWHRFGAREADVLFHAFESATAPADQKRILDGLQMIFVQAAPVIPLFNNPSWGEYSTKRFTGFPTMENPYAKLTPNNPPEYLLVLTELRP

SEQ ID NO: 518 - protein, 576 aa, Artificial
  Substituion in SEQ ID NO 511
MQKGERNMKRSKSNRGWVAAAVGLAVVGVAGCGAANTSANGASHSASASPEAASASSSSVLTVAPNVTGTFSDNFNPFSTNSMPGTLGNIYETLFYFDNTTGKQFNLLGTSFHFSNGGKILTVSLRKNAVWTDGVPFTAQDVVFTFEDLKKYPDADTNGVWQQLKSVQADGKYTVVFQFAQPNIPFAEQYVLGGTYIVPAHQWKSLGDPAKAKITHLNAIGTGPFKLSSFTTQDYQFTANPRYYGGAPEVKTLNYPAFASNSSADLALASGQIQYAGINIPNVEKTFVAADPAHNHYLFPPNESVELYPNLHNSLLAMLPVREAISLAIDRDALSKIGETGYEKPAVPTSLVLPPQSSWLDPSLPASDRAFAVNDAKAVQILQKAGFRKDQNGIFALHGKELSFNLLTISGWSDWDEDALLIKQQLAKVGIAVNVQEEQFSAYYSAIDPGPGQTPHYDLAISWTNVGPTPYTTYYDMLDSHGSFNLEGYRNAQVDQWFNEFSSTTDSQVQHQVMYRIERLVASQLPVIPLLDGALWYEYNDSHFTGFPTANNLWINPAPYTYQAAAIIMDHLKPVK

SEQ ID NO: 519 - protein, 576 aa, Artificial
  Substituion in SEQ ID NO 511
MQKGERNMKRSKSNRGWVAAAVGLAVVGVAGCGAANTSANGASHSASASPEAASASSSSVLTVAPNVTGTFSDNFNPFSTNSMPGTLGNIYETLFYFDNTTGKQFNLLGTSFHFSNGGKILTVSLRKNAVWTDGVPFTAQDVVFTFEDLKKYPDADTNGVWQQLKSVQADGKYTVVFQFAQPNIPFAEQYVLGGTYIVPAHQWKSLGDPAKAKITHLNAIGTGPFKLSSFTTQDYQFTANPRYYGGAPEVKTLNYPAFASNSSADLALASGQIQYAGIQIPNVEKTFVAADPAHNHYLFPPNESVELYPNLHNSLLAMLPVREAISLAIDRDALSKIGETGYEKPAVPTSLVLPPQSSWLDPSLPASDRAFAVNDAKAVQILQKAGFRKDQNGIFALHGKELSFNLLTVSGWSDWDEDALLIKQQLAKVGIAVNVQEEQFSAYYSAIDPGPGQTPHYDLAISWTNVGPTPYTTYYDMLDSHGSFNLEGYRNAQVDQWFNEFSSTTDSQVQHQVMYRIERLVASQLPVIPLLDGALWYEYNDSHFTGFPTANNLWINPAPYTYQAAAIIMDHLKPVK

SEQ ID NO: 520 - protein, 576 aa, Artificial
  Substituion in SEQ ID NO 511
MQKGERNMKRSKSNRGWVAAAVGLAVVGVAGCGAANTSANGASHSASASPEAASASSSSVLTVAPNVTGTFSDNFNPFSTNSMPGTLGNIYETLFYFDNTTGKQFNLLGTSFHFSNGGKILTVSLRKNAVWTDGVPFTAQDVVFTFEDLKKYPDADTNGVWQQLKSVQADGKYTVVFQFAQPNIPFAEQYVLGGTYIVPAHQWKSLGDPAKAKITHLNAIGTGPFKLSSFTTQDYQFTANPRYYGGAPEVKTLNYPAFASNSSADLALASGQIQYAGINIPNVEKTFVAADPAHNHYLFPPNESVELYPNLHNSLLAMIPVREAISLAIDRDALSKIGETGYEKPAVPTSLVLPPQSSWLDPSLPASDRAFAVNDAKAVQILQKAGFRKDQNGIFALHGKELSFNLLTVSGWSDWDEDALLIKQQLAKVGIAVNVQEEQFSAYYSAIDPGPGQTPHYDLAISWTNVGPTPYTTYYDMLDSHGSFNLEGYRNAQVDQWFNEFSSTTDSQVQHQVMYRIERLVASQLPVIPLLDGALWYEYNDSHFTGFPTANNLWINPAPYTYQAAAIIMDHLKPVK

SEQ ID NO: 521 - protein, 576 aa, Artificial
  Substituion in SEQ ID NO 511
MQKGERNMKRSKSNRGWVAAAVGLAVVGVAGCGAANTSANGASHSASASPEAASASSSSVLTVAPNVTGTFSDNFNPFSTNSMPGTLGNIYETLFYFDNTTGKQFNLLGTSFHFSNGGKILTVSLRKNAVWTDGVPFTAQDVVFTFEDLKKYPDADTNGVWQQLKSVQADGKYTVVFQFAQPNIPFAEQYVLGGTYIVPAHQWKSLGDPAKAKITHLNAIGTGPFKLSSFTTQDYQFTANPRYYGGAPEVKTLNYPAFASNSSADLALASGQIQYAGINIPNVEKTFVAADPAHNHYLFPPNESVELYPNLHNSLLAMLPVREAISLAIDRDALSKIGETGYEKPAVPTSLVLPPQSSWLDPSLPASDRAFAVNDAKAVQILQKAGFRKDQNGIFALHGKELSFNLLTVSGWSDWDEDALLIKQQLAKVGIAVNVQEEQFSAYYSAIDPGPGQTPHYDLAISWTNVGPTPYTTYYDMLDSHGSFNLEGYRNAQVDQWFNEFSSTTDSQVQHQVMYRLERLVASQLPVIPLLDGALWYEYNDSHFTGFPTANNLWINPAPYTYQAAAIIMDHLKPVK

SEQ ID NO: 522 - protein, 576 aa, Artificial
  Substituion in SEQ ID NO 511
MQKGERNMKRSKSNRGWVAAAVGLAVVGVAGCGAANTSANGASHSASASPEAASASSSSVLTVAPNVTGTFSDNFNPFSTNSMPGTLGNIYETLFYFDNTTGKQFNLLGTSFHFSNGGKILTVSLRKNAVWTDGVPFTAQDVVFTFEDLKKYPDADTNGVWQQLKSVQADGKYTVVFQFAQPNIPFAEQYVLGGTYIVPAHQWKSLGDPARAKITHLNAIGTGPFKLSSFTTQDYQFTANPRYYGGAPEVKTLNYPAFASNSSADLALASGQIQYAGINIPNVEKTFVAADPAHNHYLFPPNESVELYPNLHNSLLAMLPVREAISLAIDRDALSKIGETGYEKPAVPTSLVLPPQSSWLDPSLPASDRAFAVNDAKAVQILQKAGFRKDQNGIFALHGKELSFNLLTVSGWSDWDEDALLIKQQLAKVGIAVNVQEEQFSAYYSAIDPGPGQTPHYDLAISWTNVGPTPYTTYYDMLDSHGSFNLEGYRNAQVDQWFNEFSSTTDSQVQHQVMYRIERLVASQLPVIPLLDGALWYEYNDSHFTGFPTANNLWINPAPYTYQAAAIIMDHLKPVK

SEQ ID NO: 523 - DNA, 1731 bp, Artificial
  Substituion in SEQ ID NO 512
gtgcaaaagggggaacgaaacatgaagcggtcgaagagcaatcgaggatgggtcgccgctgcggtcggtctcgccgtggtgggtgtcgccgggtgcggcgcagcgaacacctcggcgaacggcgccagccattctgcctcggcgtcgccagaggcggcgagcgcgtcgtcgagttcggtcctgaccgtcgcgccgaacgtcacgggcaccttttcggacaacttcaatccgtttagcaccaacagcatgcccggcaccctaggcaacatctacgagacattgttctacttcgacaatacgacagggaaacagttcaacctgttggggacctccttccacttttcgaacggagggaaaatcctgacggtttctctgcgaaaaaacgcggtctggacggacggagtcccgttcacggcgcaggatgttgtcttcacgttcgaggatctcaagaagtatcccgacgcggataccaacggcgtgtggcagcagctgaagagcgtccaggccgacggaaagtacaccgtggtcttccagttcgcgcagcccaacatcccgtttgccgagcagtacgtccttgggggcacgtacattgtgccggctcatcagtggaagtcgcttggcgatccggccaaggccaagatcacgcacttgaacgccattggcacgggtccattcaagctgtcgtcctttacaactcaggactaccaattcaccgcaaatccgcgttactacggaggggcacctgaggtcaagaccctcaattatccggcgttcgccagcaactcgagtgccgatttggcgctcgcgagcggtcagattcaatacgccggcatcaacattcccaatgtcgagaagaccttcgtggcagccgatccggcgcacaaccactatttgttcccgcccaacgaatcggtggagctctatccgaacctgcacaactcgctgctcgccatgctgcctgtgcgcgaggccatcagcctggccatcgatcgcgacgcactctccaaaatcggagagacgggctatgagaagccagccgtgccgacgagtctcgtcttaccgccacagtcgtcgtggttggacccgagtctgcccgcgagcgatcgcgcctttgcggtcaacgatgccaaagcggttcagattttgcagaaggcaggcttccgcaaggaccaaaacgggatttttgcgctccatggcaaggagttgtccttcaacttactcacgattagcggttggagcgactgggatgaggacgcgctgctcatcaagcagcagttggcgaaggtcgggatcgccgtgaatgtccaggaggagcagttctcggcctactacagcgctatcgatccgggcccgggccagacgccgcactacgacctcgccatctcgtggaccaacgtggggcctacgccgtacacgacgtattacgacatgttggattcgcacggatcctttaatttggaaggctatcgcaatgcgcaggtggatcagtggttcaacgagttttcgtcgaccacggatagccaggttcagcaccaggtgatgtacaggattgagcgactcgtggcgagccaactgccggtcatcccgctgttggatggcgcgctctggtacgagtacaacgacagccacttcacgggcttcccgacggccaacaacctctggatcaatccggcgccgtacacctaccaggcggctgccatcatcatggatcacctgaagccggtgaagtga

SEQ ID NO: 524 - DNA, 1731 bp, Artificial
  Substituion in SEQ ID NO 512
gtgcaaaagggggaacgaaacatgaagcggtcgaagagcaatcgaggatgggtcgccgctgcggtcggtctcgccgtggtgggtgtcgccgggtgcggcgcagcgaacacctcggcgaacggcgccagccattctgcctcggcgtcgccagaggcggcgagcgcgtcgtcgagttcggtcctgaccgtcgcgccgaacgtcacgggcaccttttcggacaacttcaatccgtttagcaccaacagcatgcccggcaccctaggcaacatctacgagacattgttctacttcgacaatacgacagggaaacagttcaacctgttggggacctccttccacttttcgaacggagggaaaatcctgacggtttctctgcgaaaaaacgcggtctggacggacggagtcccgttcacggcgcaggatgttgtcttcacgttcgaggatctcaagaagtatcccgacgcggataccaacggcgtgtggcagcagctgaagagcgtccaggccgacggaaagtacaccgtggtcttccagttcgcgcagcccaacatcccgtttgccgagcagtacgtccttgggggcacgtacattgtgccggctcatcagtggaagtcgcttggcgatccggccaaggccaagatcacgcacttgaacgccattggcacgggtccattcaagctgtcgtcctttacaactcaggactaccaattcaccgcaaatccgcgttactacggaggggcacctgaggtcaagaccctcaattatccggcgttcgccagcaactcgagtgccgatttggcgctcgcgagcggtcagattcaatacgccggcatccaaattcccaatgtcgagaagaccttcgtggcagccgatccggcgcacaaccactatttgttcccgcccaacgaatcggtggagctctatccgaacctgcacaactcgctgctcgccatgctgcctgtgcgcgaggccatcagcctggccatcgatcgcgacgcactctccaaaatcggagagacgggctatgagaagccagccgtgccgacgagtctcgtcttaccgccacagtcgtcgtggttggacccgagtctgcccgcgagcgatcgcgcctttgcggtcaacgatgccaaagcggttcagattttgcagaaggcaggcttccgcaaggaccaaaacgggatttttgcgctccatggcaaggagttgtccttcaacttactcacggtaagcggttggagcgactgggatgaggacgcgctgctcatcaagcagcagttggcgaaggtcgggatcgccgtgaatgtccaggaggagcagttctcggcctactacagcgctatcgatccgggcccgggccagacgccgcactacgacctcgccatctcgtggaccaacgtggggcctacgccgtacacgacgtattacgacatgttggattcgcacggatcctttaatttggaaggctatcgcaatgcgcaggtggatcagtggttcaacgagttttcgtcgaccacggatagccaggttcagcaccaggtgatgtacaggattgagcgactcgtggcgagccaactgccggtcatcccgctgttggatggcgcgctctggtacgagtacaacgacagccacttcacgggcttcccgacggccaacaacctctggatcaatccggcgccgtacacctaccaggcggctgccatcatcatggatcacctgaagccggtgaagtga

SEQ ID NO: 525 - DNA, 1731 bp, Artificial
  Substituion in SEQ ID NO 512
gtgcaaaagggggaacgaaacatgaagcggtcgaagagcaatcgaggatgggtcgccgctgcggtcggtctcgccgtggtgggtgtcgccgggtgcggcgcagcgaacacctcggcgaacggcgccagccattctgcctcggcgtcgccagaggcggcgagcgcgtcgtcgagttcggtcctgaccgtcgcgccgaacgtcacgggcaccttttcggacaacttcaatccgtttagcaccaacagcatgcccggcaccctaggcaacatctacgagacattgttctacttcgacaatacgacagggaaacagttcaacctgttggggacctccttccacttttcgaacggagggaaaatcctgacggtttctctgcgaaaaaacgcggtctggacggacggagtcccgttcacggcgcaggatgttgtcttcacgttcgaggatctcaagaagtatcccgacgcggataccaacggcgtgtggcagcagctgaagagcgtccaggccgacggaaagtacaccgtggtcttccagttcgcgcagcccaacatcccgtttgccgagcagtacgtccttgggggcacgtacattgtgccggctcatcagtggaagtcgcttggcgatccggccaaggccaagatcacgcacttgaacgccattggcacgggtccattcaagctgtcgtcctttacaactcaggactaccaattcaccgcaaatccgcgttactacggaggggcacctgaggtcaagaccctcaattatccggcgttcgccagcaactcgagtgccgatttggcgctcgcgagcggtcagattcaatacgccggcatcaacattcccaatgtcgagaagaccttcgtggcagccgatccggcgcacaaccactatttgttcccgcccaacgaatcggtggagctctatccgaacctgcacaactcgctgctcgccatgattcctgtgcgcgaggccatcagcctggccatcgatcgcgacgcactctccaaaatcggagagacgggctatgagaagccagccgtgccgacgagtctcgtcttaccgccacagtcgtcgtggttggacccgagtctgcccgcgagcgatcgcgcctttgcggtcaacgatgccaaagcggttcagattttgcagaaggcaggcttccgcaaggaccaaaacgggatttttgcgctccatggcaaggagttgtccttcaacttactcacggtaagcggttggagcgactgggatgaggacgcgctgctcatcaagcagcagttggcgaaggtcgggatcgccgtgaatgtccaggaggagcagttctcggcctactacagcgctatcgatccgggcccgggccagacgccgcactacgacctcgccatctcgtggaccaacgtggggcctacgccgtacacgacgtattacgacatgttggattcgcacggatcctttaatttggaaggctatcgcaatgcgcaggtggatcagtggttcaacgagttttcgtcgaccacggatagccaggttcagcaccaggtgatgtacaggattgagcgactcgtggcgagccaactgccggtcatcccgctgttggatggcgcgctctggtacgagtacaacgacagccacttcacgggcttcccgacggccaacaacctctggatcaatccggcgccgtacacctaccaggcggctgccatcatcatggatcacctgaagccggtgaagtga

SEQ ID NO: 526 - DNA, 1731 bp, Artificial
  Substituion in SEQ ID NO 512
gtgcaaaagggggaacgaaacatgaagcggtcgaagagcaatcgaggatgggtcgccgctgcggtcggtctcgccgtggtgggtgtcgccgggtgcggcgcagcgaacacctcggcgaacggcgccagccattctgcctcggcgtcgccagaggcggcgagcgcgtcgtcgagttcggtcctgaccgtcgcgccgaacgtcacgggcaccttttcggacaacttcaatccgtttagcaccaacagcatgcccggcaccctaggcaacatctacgagacattgttctacttcgacaatacgacagggaaacagttcaacctgttggggacctccttccacttttcgaacggagggaaaatcctgacggtttctctgcgaaaaaacgcggtctggacggacggagtcccgttcacggcgcaggatgttgtcttcacgttcgaggatctcaagaagtatcccgacgcggataccaacggcgtgtggcagcagctgaagagcgtccaggccgacggaaagtacaccgtggtcttccagttcgcgcagcccaacatcccgtttgccgagcagtacgtccttgggggcacgtacattgtgccggctcatcagtggaagtcgcttggcgatccggccaaggccaagatcacgcacttgaacgccattggcacgggtccattcaagctgtcgtcctttacaactcaggactaccaattcaccgcaaatccgcgttactacggaggggcacctgaggtcaagaccctcaattatccggcgttcgccagcaactcgagtgccgatttggcgctcgcgagcggtcagattcaatacgccggcatcaacattcccaatgtcgagaagaccttcgtggcagccgatccggcgcacaaccactatttgttcccgcccaacgaatcggtggagctctatccgaacctgcacaactcgctgctcgccatgctgcctgtgcgcgaggccatcagcctggccatcgatcgcgacgcactctccaaaatcggagagacgggctatgagaagccagccgtgccgacgagtctcgtcttaccgccacagtcgtcgtggttggacccgagtctgcccgcgagcgatcgcgcctttgcggtcaacgatgccaaagcggttcagattttgcagaaggcaggcttccgcaaggaccaaaacgggatttttgcgctccatggcaaggagttgtccttcaacttactcacggtaagcggttggagcgactgggatgaggacgcgctgctcatcaagcagcagttggcgaaggtcgggatcgccgtgaatgtccaggaggagcagttctcggcctactacagcgctatcgatccgggcccgggccagacgccgcactacgacctcgccatctcgtggaccaacgtggggcctacgccgtacacgacgtattacgacatgttggattcgcacggatcctttaatttggaaggctatcgcaatgcgcaggtggatcagtggttcaacgagttttcgtcgaccacggatagccaggttcagcaccaggtgatgtacaggttagagcgactcgtggcgagccaactgccggtcatcccgctgttggatggcgcgctctggtacgagtacaacgacagccacttcacgggcttcccgacggccaacaacctctggatcaatccggcgccgtacacctaccaggcggctgccatcatcatggatcacctgaagccggtgaagtga

SEQ ID NO: 527 - DNA, 1731 bp, Artificial
  Substituion in SEQ ID NO 512
gtgcaaaagggggaacgaaacatgaagcggtcgaagagcaatcgaggatgggtcgccgctgcggtcggtctcgccgtggtgggtgtcgccgggtgcggcgcagcgaacacctcggcgaacggcgccagccattctgcctcggcgtcgccagaggcggcgagcgcgtcgtcgagttcggtcctgaccgtcgcgccgaacgtcacgggcaccttttcggacaacttcaatccgtttagcaccaacagcatgcccggcaccctaggcaacatctacgagacattgttctacttcgacaatacgacagggaaacagttcaacctgttggggacctccttccacttttcgaacggagggaaaatcctgacggtttctctgcgaaaaaacgcggtctggacggacggagtcccgttcacggcgcaggatgttgtcttcacgttcgaggatctcaagaagtatcccgacgcggataccaacggcgtgtggcagcagctgaagagcgtccaggccgacggaaagtacaccgtggtcttccagttcgcgcagcccaacatcccgtttgccgagcagtacgtccttgggggcacgtacattgtgccggctcatcagtggaagtcgcttggcgatccggcccgtgccaagatcacgcacttgaacgccattggcacgggtccattcaagctgtcgtcctttacaactcaggactaccaattcaccgcaaatccgcgttactacggaggggcacctgaggtcaagaccctcaattatccggcgttcgccagcaactcgagtgccgatttggcgctcgcgagcggtcagattcaatacgccggcatcaacattcccaatgtcgagaagaccttcgtggcagccgatccggcgcacaaccactatttgttcccgcccaacgaatcggtggagctctatccgaacctgcacaactcgctgctcgccatgctgcctgtgcgcgaggccatcagcctggccatcgatcgcgacgcactctccaaaatcggagagacgggctatgagaagccagccgtgccgacgagtctcgtcttaccgccacagtcgtcgtggttggacccgagtctgcccgcgagcgatcgcgcctttgcggtcaacgatgccaaagcggttcagattttgcagaaggcaggcttccgcaaggaccaaaacgggatttttgcgctccatggcaaggagttgtccttcaacttactcacggtaagcggttggagcgactgggatgaggacgcgctgctcatcaagcagcagttggcgaaggtcgggatcgccgtgaatgtccaggaggagcagttctcggcctactacagcgctatcgatccgggcccgggccagacgccgcactacgacctcgccatctcgtggaccaacgtggggcctacgccgtacacgacgtattacgacatgttggattcgcacggatcctttaatttggaaggctatcgcaatgcgcaggtggatcagtggttcaacgagttttcgtcgaccacggatagccaggttcagcaccaggtgatgtacaggattgagcgactcgtggcgagccaactgccggtcatcccgctgttggatggcgcgctctggtacgagtacaacgacagccacttcacgggcttcccgacggccaacaacctctggatcaatccggcgccgtacacctaccaggcggctgccatcatcatggatcacctgaagccggtgaagtga

SEQ ID NO: 528 - protein, 328 aa, Alicyclobacillus acidocaldarius
MRYFLNRFCFLVLSLWAAITLNFILPRLMPGNPAQAMIAKQAGNINPAALKAIEEQLGLSNGPLWQQYFQYLGNLLTGHWGASFQYFPTPVVNIIETSLPWTIVLLGVVTIISVVVGTLIGILIAWRRGGTADNVIPVATMFGQAIPTFWLGLILIYFFGFVHHWFPLAHGYGDDVTPGLNAPFLASAVYHSILPAVVVFVGSISGWIVGMRNNMITTLGEDYVVFAEAKGVSKRRLIFSYAARNALLPQLTSVAIALSSIIGGQILIEQVFSYPGIGYGLTNAVASEDYPLIQGMFLIIAVTALVINFIVDMLYGRLDPRVRRRGAA

SEQ ID NO: 529 - DNA, 987 bp, Alicyclobacillus acidocaldarius
atgcgatatttcctaaatcgattttgttttctcgtcttgtcgctttgggcggctatcacgctgaacttcatcctgccgcgcctcatgcccggcaaccctgctcaggcgatgatcgctaagcaggccgggaatatcaatcctgccgcactgaaagccattgaggagcagctcgggctgtcaaatggtcccctgtggcagcagtattttcagtacctcggaaatctgttgacagggcactggggcgcttcgtttcagtactttccgaccccggtcgtcaacatcattgagacgagcctgccgtggaccatcgtgctgctcggcgtggtgaccatcatctccgtggtcgtcggaacgctcatcggcattctcatcgcctggcgccgcggcggaaccgcggacaacgtgatcccggtagccacgatgttcggccaggccatcccgaccttctggctcggcctcattctcatctacttcttcgggttcgtgcatcactggtttccgctcgcgcacggatacggagacgacgtgacgccggggctcaacgctccgtttctggcgagcgcggtctaccacagcatcctgccggcggtggtggtgttcgtcggcagcatcagcggctggatcgtgggcatgcgcaacaacatgatcacgacgctcggagaggactatgtggtcttcgccgaggccaaaggggtatcgaagcggaggctcattttttcgtacgccgcgcgcaatgcgctcctgcctcagttgacctccgtggccatcgcgctctcgtcgatcatcggcgggcaaattctcattgaacaagtgttttcctacccaggcatcggatacggcctgaccaacgcggtggcgagtgaagactatccgctcattcaagggatgtttctcatcattgcggtgacagcgcttgtgatcaacttcattgtcgacatgctgtacggacggctcgatccgcgcgtgcgtagaaggggggcggcgtga

SEQ ID NO: 530 - protein, 323 aa, Arthrobacter sp. FB24
MRFILRRLGFYLIAFWVSITLNFLLPRFMPGDPVSRMFARTQDRMQPEQIEALRKLLGVDDRPIWEQYVDYLHNMVTGQMGVSISRFPTPVTEVIASQVGWTLLLGGTALVIAAVVGNLLGILAAWRRGGAIDSALPPILIFIGSFPYFWLAMGALYLFGVTLGWFPIRHAFSDTIEPSFSWEFMSDVGMHLVLPALTIVLVSVGGWMLGMRNTMIATNAEDYITMAEAKGLRPGRIMFRYAARNAMLPSVTSFGMSLGFVVGGALLTEVVFAYPGVGYQLLNAVQGLDYPLMQGLFLTITAAVLLANFLVDILYVRLDPRVR

SEQ ID NO: 531 - protein, 323 aa, Arthrobacter aurescens TC1
MRFILRRLGFYLIAFWASITLNFLLPRFMPGDPVSRMFARSQDRMQPEQIEALRKLLGVDDRPIWEQYIDYMHNIFTGQMGVSISRFPTPVTEVISAQIGWTLLLGGTALVVAAVVGNLLGILAAWRRGGAIDSALPPLLVFIGSFPYFWLAMGALYLFGVVLGWFPIRHAFTDGLEPAFTWEFIGDVGAHLVLPALTIVLVSIGGWMLGMRNTMIATNSEDYITMAEAKGLRPGRIMLRYAARNAMLPSVTSFGMGLGFVVGGALLTEVVFAYPGVGYQLLNAVQGLDYPLMQGLFLTITAAVLLANFLVDILYVRLDPRVR

SEQ ID NO: 532 - protein, 326 aa, Lactococcus lactis subsp. cremoris MG1363
MRFFIRRVAFYIVTAWAAVTLNFFIPRMMPGDPVQALIARYQGQISVDAVNSLRKLFGMDAHESLWQQYIDYWVKLFHGNLGVSLQSFPTPVSQIISQSLPWTIGLVGLATIIAFVVGTVIGIILGWRRGTKWDALIPITTFFSSVPYFWIGLMAIAIFATVLQWFPQGGSYSVDSLPGLNWAFMSSVFYYGFLPALTIVLSSMAGWILGMRNMMVTVSSEDYVTVAHAKGLRESVVMFRYASRNAILPQISGFALSLGFVVSGTLVMEQVFNYQGIGYRLLQATNNHDYPLMQGIFLVITLSVLIANVVADIIYAFLDPRTRKEG

SEQ ID NO: 533 - protein, 325 aa, Sorangium cellulosum 'So ce 56'
MRYLLRQLGLYFIAAWASLTLNFLIPRAMPGDPASAMFVRFRGQLQPEAIEALRKAFGFTDEPLYKQYFTYLSHILVGDLGTSVAHFPAKVTEVIATGLGWTLLLSGAAVIVSFGLGTLLGIIATWKRGGWLDSVMPPVLMFLGAFPYFWLAMVSLYLLGFVLGAFPLRHAYSDTLSPEWSLEFIGSVLSHMILPALSIVIATIGGWMLGMRSAMVTVLSEEYITMAQAKGLSQWRVMFTYAARNALLPNVTGFGMALGFVLAGSLLTEIVFSYPGQGYLLIQAVRNQDYPLMQGIFLTITFAVLGANFLVDVIYVFLDPRARGR

SEQ ID NO: 534 - protein, 325 aa, Herpetosiphon aurantiacus ATCC 23779
MRFLLRRLGFYAVAAWVSLTVNFYLPRLMPGDPASAIFARFQGRLRPEEIDSLRKAYGLSDAPLLEQYFNYLRSLSRGEFGISINFFPAQVTDVISTGFMWTILLAGLATVISFFLGNVLGIIGAWRRNGILDSVAPPLLTFIGAFPYFFLAMIALYFLAFQAGWFPLRHAYSDALSVDWGSLTFIKSVISHMILPASCIVLASIGGWMLGMRNTMVGILSEDYITMAQAKGLSQQRIMFSYAARNALLPNVTSFGMALGFVLSGSLLTEIIFAYPGLGYLLLQAVRNLDYPLMQGLFLMITFAVLGANLLVDILYVWLDPRTRR

SEQ ID NO: 535 - protein, 328 aa, Artificial
  Substituion in SEQ ID NO 528
MRYFLNRFCFLVLSLWAALTLNFILPRLMPGNPAQAMIAKQAGNINPAALKAIEEQLGLSNGPLWQQYFQYLGNLLTGHWGASFQYFPTPVVNIIETSLPWTIVLLGVVTIISVVVGTLIGILIAWRRGGTADNVIPVATMFGQAIPTFWLGLILIYFFGFVHHWFPLAHGYGDDVTPGLNAPFLASAVYHSILPAVVVFVGSISGWIVGMRNNMITTLGEDYVVFAEAKGVSKRRLIFSYAARNALLPQLTSVAIALSSIIGGQILIEQVFSYPGIGYGLTNAVASEDYPLIQGMFLIIAVTALVINFIVDMLYGRLDPRVRRRGAA

SEQ ID NO: 536 - protein, 328 aa, Artificial
  Substituion in SEQ ID NO 528
MRYFLNRFCFLVLSLWAAITLNFILPRLMPGNPAQAMIAKQAGNINPAALKAIEEQLGLSNGPLWQQYFQYLGNLLTGHWGASFQYFPTPVVNIIETSLPWTIVLLGVVTIISVVVGTLIGILIAWRRGGTADNVIPVATMFGQAIPTFWLGLILIYFFGFVHHWFPLAHGYGDDVTPGLNAPFLASAVYHSILPAVVVFVGSISGWIVGMRNNMITTLGEDYVVFAEAKGVSKRRLIFSYAARNALLPQLTSIAIALSSIIGGQILIEQVFSYPGIGYGLTNAVASEDYPLIQGMFLIIAVTALVINFIVDMLYGRLDPRVRRRGAA

SEQ ID NO: 537 - protein, 328 aa, Artificial
  Substituion in SEQ ID NO 528
MRYFLNRFCFIVLSLWAAITLNFILPRLMPGNPAQAMIAKQAGNINPAALKAIEEQLGLSNGPLWQQYFQYLGNLLTGHWGASFQYFPTPVVNIIETSLPWTIVLLGVVTIISVVVGTLIGILIAWRRGGTADNVIPVATMFGQAIPTFWLGLILIYFFGFVHHWFPLAHGYGDDVTPGLNAPFLASAVYHSILPAVVVFVGSISGWIVGMRNNMITTLGEDYVVFAEAKGVSKRRLIFSYAARNALLPQLTSVAIALSSIIGGQILIEQVFSYPGIGYGLTNAVASEDYPLIQGMFLIIAVTALVINFIVDMLYGRLDPRVRRRGAA

SEQ ID NO: 538 - protein, 328 aa, Artificial
  Substituion in SEQ ID NO 528
MRYFLQRFCFLVLSLWAAITLNFILPRLMPGNPAQAMIAKQAGNINPAALKAIEEQLGLSNGPLWQQYFQYLGNLLTGHWGASFQYFPTPVVNIIETSLPWTIVLLGVVTIISVVVGTLIGILIAWRRGGTADNVIPVATMFGQAIPTFWLGLILIYFFGFVHHWFPLAHGYGDDVTPGLNAPFLASAVYHSILPAVVVFVGSISGWIVGMRNNMITTLGEDYVVFAEAKGVSKRRLIFSYAARNALLPQLTSVAIALSSIIGGQILIEQVFSYPGIGYGLTNAVASEDYPLIQGMFLIIAVTALVINFIVDMLYGRLDPRVRRRGAA

SEQ ID NO: 539 - protein, 328 aa, Artificial
  Substituion in SEQ ID NO 528
MRYFLNRFCFLVLSLWAAITLNFILPRLMPGNPAQAMIAKQAGNINPAALKAIEEQLGLSNGPLWQQYFQYLGNLLTGHWGASFQYFPTPVVNIIETSLPWTIVLLGVVTIISVIVGTLIGILIAWRRGGTADNVIPVATMFGQAIPTFWLGLILIYFFGFVHHWFPLAHGYGDDVTPGLNAPFLASAVYHSILPAVVVFVGSISGWIVGMRNNMITTLGEDYVVFAEAKGVSKRRLIFSYAARNALLPQLTSVAIALSSIIGGQILIEQVFSYPGIGYGLTNAVASEDYPLIQGMFLIIAVTALVINFIVDMLYGRLDPRVRRRGAA

SEQ ID NO: 540 - DNA, 987 bp, Artificial
  Substituion in SEQ ID NO 529
atgcgatatttcctaaatcgattttgttttctcgtcttgtcgctttgggcggctttaacgctgaacttcatcctgccgcgcctcatgcccggcaaccctgctcaggcgatgatcgctaagcaggccgggaatatcaatcctgccgcactgaaagccattgaggagcagctcgggctgtcaaatggtcccctgtggcagcagtattttcagtacctcggaaatctgttgacagggcactggggcgcttcgtttcagtactttccgaccccggtcgtcaacatcattgagacgagcctgccgtggaccatcgtgctgctcggcgtggtgaccatcatctccgtggtcgtcggaacgctcatcggcattctcatcgcctggcgccgcggcggaaccgcggacaacgtgatcccggtagccacgatgttcggccaggccatcccgaccttctggctcggcctcattctcatctacttcttcgggttcgtgcatcactggtttccgctcgcgcacggatacggagacgacgtgacgccggggctcaacgctccgtttctggcgagcgcggtctaccacagcatcctgccggcggtggtggtgttcgtcggcagcatcagcggctggatcgtgggcatgcgcaacaacatgatcacgacgctcggagaggactatgtggtcttcgccgaggccaaaggggtatcgaagcggaggctcattttttcgtacgccgcgcgcaatgcgctcctgcctcagttgacctccgtggccatcgcgctctcgtcgatcatcggcgggcaaattctcattgaacaagtgttttcctacccaggcatcggatacggcctgaccaacgcggtggcgagtgaagactatccgctcattcaagggatgtttctcatcattgcggtgacagcgcttgtgatcaacttcattgtcgacatgctgtacggacggctcgatccgcgcgtgcgtagaaggggggcggcgtga

SEQ ID NO: 541 - DNA, 987 bp, Artificial
  Substituion in SEQ ID NO 529
atgcgatatttcctaaatcgattttgttttctcgtcttgtcgctttgggcggctatcacgctgaacttcatcctgccgcgcctcatgcccggcaaccctgctcaggcgatgatcgctaagcaggccgggaatatcaatcctgccgcactgaaagccattgaggagcagctcgggctgtcaaatggtcccctgtggcagcagtattttcagtacctcggaaatctgttgacagggcactggggcgcttcgtttcagtactttccgaccccggtcgtcaacatcattgagacgagcctgccgtggaccatcgtgctgctcggcgtggtgaccatcatctccgtggtcgtcggaacgctcatcggcattctcatcgcctggcgccgcggcggaaccgcggacaacgtgatcccggtagccacgatgttcggccaggccatcccgaccttctggctcggcctcattctcatctacttcttcgggttcgtgcatcactggtttccgctcgcgcacggatacggagacgacgtgacgccggggctcaacgctccgtttctggcgagcgcggtctaccacagcatcctgccggcggtggtggtgttcgtcggcagcatcagcggctggatcgtgggcatgcgcaacaacatgatcacgacgctcggagaggactatgtggtcttcgccgaggccaaaggggtatcgaagcggaggctcattttttcgtacgccgcgcgcaatgcgctcctgcctcagttgacctccattgccatcgcgctctcgtcgatcatcggcgggcaaattctcattgaacaagtgttttcctacccaggcatcggatacggcctgaccaacgcggtggcgagtgaagactatccgctcattcaagggatgtttctcatcattgcggtgacagcgcttgtgatcaacttcattgtcgacatgctgtacggacggctcgatccgcgcgtgcgtagaaggggggcggcgtga

SEQ ID NO: 542 - DNA, 987 bp, Artificial
  Substituion in SEQ ID NO 529
atgcgatatttcctaaatcgattttgttttattgtcttgtcgctttgggcggctatcacgctgaacttcatcctgccgcgcctcatgcccggcaaccctgctcaggcgatgatcgctaagcaggccgggaatatcaatcctgccgcactgaaagccattgaggagcagctcgggctgtcaaatggtcccctgtggcagcagtattttcagtacctcggaaatctgttgacagggcactggggcgcttcgtttcagtactttccgaccccggtcgtcaacatcattgagacgagcctgccgtggaccatcgtgctgctcggcgtggtgaccatcatctccgtggtcgtcggaacgctcatcggcattctcatcgcctggcgccgcggcggaaccgcggacaacgtgatcccggtagccacgatgttcggccaggccatcccgaccttctggctcggcctcattctcatctacttcttcgggttcgtgcatcactggtttccgctcgcgcacggatacggagacgacgtgacgccggggctcaacgctccgtttctggcgagcgcggtctaccacagcatcctgccggcggtggtggtgttcgtcggcagcatcagcggctggatcgtgggcatgcgcaacaacatgatcacgacgctcggagaggactatgtggtcttcgccgaggccaaaggggtatcgaagcggaggctcattttttcgtacgccgcgcgcaatgcgctcctgcctcagttgacctccgtggccatcgcgctctcgtcgatcatcggcgggcaaattctcattgaacaagtgttttcctacccaggcatcggatacggcctgaccaacgcggtggcgagtgaagactatccgctcattcaagggatgtttctcatcattgcggtgacagcgcttgtgatcaacttcattgtcgacatgctgtacggacggctcgatccgcgcgtgcgtagaaggggggcggcgtga

SEQ ID NO: 543 - DNA, 987 bp, Artificial
  Substituion in SEQ ID NO 529
atgcgatatttcctacaacgattttgttttctcgtcttgtcgctttgggcggctatcacgctgaacttcatcctgccgcgcctcatgcccggcaaccctgctcaggcgatgatcgctaagcaggccgggaatatcaatcctgccgcactgaaagccattgaggagcagctcgggctgtcaaatggtcccctgtggcagcagtattttcagtacctcggaaatctgttgacagggcactggggcgcttcgtttcagtactttccgaccccggtcgtcaacatcattgagacgagcctgccgtggaccatcgtgctgctcggcgtggtgaccatcatctccgtggtcgtcggaacgctcatcggcattctcatcgcctggcgccgcggcggaaccgcggacaacgtgatcccggtagccacgatgttcggccaggccatcccgaccttctggctcggcctcattctcatctacttcttcgggttcgtgcatcactggtttccgctcgcgcacggatacggagacgacgtgacgccggggctcaacgctccgtttctggcgagcgcggtctaccacagcatcctgccggcggtggtggtgttcgtcggcagcatcagcggctggatcgtgggcatgcgcaacaacatgatcacgacgctcggagaggactatgtggtcttcgccgaggccaaaggggtatcgaagcggaggctcattttttcgtacgccgcgcgcaatgcgctcctgcctcagttgacctccgtggccatcgcgctctcgtcgatcatcggcgggcaaattctcattgaacaagtgttttcctacccaggcatcggatacggcctgaccaacgcggtggcgagtgaagactatccgctcattcaagggatgtttctcatcattgcggtgacagcgcttgtgatcaacttcattgtcgacatgctgtacggacggctcgatccgcgcgtgcgtagaaggggggcggcgtga

SEQ ID NO: 544 - DNA, 987 bp, Artificial
  Substituion in SEQ ID NO 529
atgcgatatttcctaaatcgattttgttttctcgtcttgtcgctttgggcggctatcacgctgaacttcatcctgccgcgcctcatgcccggcaaccctgctcaggcgatgatcgctaagcaggccgggaatatcaatcctgccgcactgaaagccattgaggagcagctcgggctgtcaaatggtcccctgtggcagcagtattttcagtacctcggaaatctgttgacagggcactggggcgcttcgtttcagtactttccgaccccggtcgtcaacatcattgagacgagcctgccgtggaccatcgtgctgctcggcgtggtgaccatcatctccgtgattgtcggaacgctcatcggcattctcatcgcctggcgccgcggcggaaccgcggacaacgtgatcccggtagccacgatgttcggccaggccatcccgaccttctggctcggcctcattctcatctacttcttcgggttcgtgcatcactggtttccgctcgcgcacggatacggagacgacgtgacgccggggctcaacgctccgtttctggcgagcgcggtctaccacagcatcctgccggcggtggtggtgttcgtcggcagcatcagcggctggatcgtgggcatgcgcaacaacatgatcacgacgctcggagaggactatgtggtcttcgccgaggccaaaggggtatcgaagcggaggctcattttttcgtacgccgcgcgcaatgcgctcctgcctcagttgacctccgtggccatcgcgctctcgtcgatcatcggcgggcaaattctcattgaacaagtgttttcctacccaggcatcggatacggcctgaccaacgcggtggcgagtgaagactatccgctcattcaagggatgtttctcatcattgcggtgacagcgcttgtgatcaacttcattgtcgacatgctgtacggacggctcgatccgcgcgtgcgtagaaggggggcggcgtga

SEQ ID NO: 545 - protein, 331 aa, Alicyclobacillus acidocaldarius
MTVAAIDVVDPRAKRASRRRNSALRQFFRNPKALAGVVLFGMFLVVAIFAPAIAPYNPTSTAFGMLQPPSHAHWFGTTSLGQDVFSQFIWGTRTTLIVGVGAGLLSTVIAILIGVTAGYVGGVVDSILNALCNIFLVMPGLALLIIIESYVHNTTPYMNGLIIALTGWAWGARVMRSMAMTIASRDYIAAARLSGMSTFRIILFEIVPNMTSVIASNVMYACLAAVLAESGLAYLGFENVASTSWGTMLYWATQNSALMSGAWWWFVPPGLGIALLGTSFALMNFGIDQVTNPRLRTSRRRRQVEKLLRELRAQNGEVKADGRDARTGASD

SEQ ID NO: 546 - DNA, 996 bp, Alicyclobacillus acidocaldarius
atgacagtcgcagccatcgatgtggtggatccgcgcgcgaagcgggcgagcaggcgcagaaactcggcgttgcgccagttctttcgaaatccgaaggcgctcgcgggcgtcgtcctgtttggcatgtttctggtggtggccatttttgcgcctgccatcgcgccctacaatccaacttccacggcgtttggcatgctgcaacctccgtcgcacgcgcactggttcggcacgacgagccttggccaggacgtgttttcacagttcatctggggcacgcggaccacgctcatcgtgggcgtcggagcggggcttttgagcaccgtgatcgccatcctgatcggcgtgacggcagggtatgtcggcggcgtggtcgattcaatcctaaacgcgctctgtaacattttcctcgtcatgccgggattggcgctgctcatcatcatcgaatcgtacgtgcacaacacgacgccgtatatgaacggtctgatcatcgcgctgacgggctgggcgtggggcgcgcgcgtgatgcggtccatggccatgaccattgcgagccgggattacatcgcggcggcgcgcctgtcggggatgtcgacgttccgcatcatcctgttcgagatcgtgccgaacatgacgagcgtcattgcctccaacgtgatgtacgcctgtctggcggcggtgctcgcggagtcgggcctcgcgtatctcgggttcgaaaatgtggcctcgacgagctggggcacgatgctgtactgggcgacgcagaacagcgcgctgatgagcggggcgtggtggtggttcgtgccgccggggctcggcatcgcgcttctcggcacgagctttgccctgatgaacttcggcatcgaccaggtcaccaacccgcgtctgcgcacgtcgcgcaggcgtcgacaggtcgagaaactgctgcgcgagcttcgggcgcagaacggtgaggtgaaggcggatggcagagacgcgagaaccggtgcttcagattga

SEQ ID NO: 547 - protein, 267 aa, Lactococcus lactis subsp. cremoris MG1363
FLRNTKSIIGLSIFTFFILVAIFGPLLAPFDPNKTSALANAAPSTQHWLGTTNVGQDIFSQIIIGTRGVMVVSLSTGLIATVLAAVIGVSAGFLSGWGDEILSMLTNIFLVIPGLPLIIIIMGTMTNAGLAAIVLVISFTGWAWGARVLRSQTMSLRTRDFVEAARASGESRLRIIIFEILPNLTAILASTFIGTVTAAIMSLVTLSYIGIIPPSDWSWGTVLYYAQNNGAFTSGQWWWYAPAGLCVAFLGMSLALINFGIDEFVNP

SEQ ID NO: 548 - protein, 264 aa, Petrotoga mobilis SJ95
NKKAIVGLSIILFFVIVAVFAPFFAPYNPNDFVGPPYSQPTFNHPLGLDRMGRDILSQLIYGTRLSLIVGLSTGALMTSISILIGMTAGYFGGLVDRILSTIIDVFMVIPGLPLMIVIASYIRIRGVVPIILVIAFTSWAPGARVIRSQTLTMRGREFILASKITGEKSGRIIFSEIMPNMFSLLSSNFFMACLTAIVGEASLEFLGFGDVSSITWGTMLYWAQNSSALLNNSWGWVLAPGAAIATLGASFALLNFSIDEITNP

SEQ ID NO: 549 - protein, 294 aa, Silicibacter sp. TM1040
FLRNRKAAIGLTIVLIYVAIAIAAPLIAPFDPIARVGRPHQPPSVEHWLGTTRMGRDVFSQLVWGTRTSLMVGIVAGLIVTAIGTFIGITAAYFGGLVDDILNFFTNVVLVLPQLPLLLVLAAFLGQVGPWAIALIIGLTSWAWGARVTRAQAMSLKTRDFIQASAMIGEPTWRMILVEMLPNLLSIIGFNFIGSVIFTIITEATLEFLGLGSPLALSWGTMLYNAQTASAIMVGAWWEVLAPCAAIVLIGVGLSLMNFGVDEIANPRMRTLGNVAKALRIEKRLLRQRMQEAE

SEQ ID NO: 550 - protein, 257 aa, Thermotoga lettingae TMO
AGIILFFLTIALLAPYIAPYNPNDIVDLPYEKPSKLHFLGTDRLGRDIFSQLIHGTRLSLLIGILTGFLMTGISTFFGMTSGYYGGIVDRILSTITDVFLVIPGIPLMIVISSYIRVRSFWTVIIVIALTGWGGGARVIRSQMLSMKNREFVTAAKIIGEKNIRIVFFEIFPNMLSLIASNFFGSVLYAIIGEASLSFLGLGDVSRISWGTMLYWAQSANALLNGMWAWVLAPGLSIVLLGTAFALLNFSLDEMTNP

SEQ ID NO: 551 - protein, 266 aa, Leifsonia xyli subsp. xyli str. CTCB07
WRDPKCRVGMFLLAAFLLAAALAPLIAPFDPREAVGGASEGPSAAHWLGTTDNGEDVLSQLIWGAQTSLIVGLIAGLISTAIGLVIGLTAGYSQGVVDEILSFLTNLALVVPVLPLIVTLASYSPVRGIWMIIFVISVTGWAYGARIKRSQVISLRTRDYVAAEKLAGDRTPRIILREIMPNMTSLIVVSFMGAALGAIGGEGGLAFLGLGDPQTVSWGAMLYQANIGGALLTGQLAWLIAPGLTLALLITSFTLINFGIDTLSNP

SEQ ID NO: 552 - protein, 331 aa, Artificial
  Substituion in SEQ ID NO 545
MTVAAIDVVDPRAKRASRRRNSALRQFFRNPKALAGVVLFGMFLVVAIFAPAIAPYNPTSTAFGMLQPPSHAHWFGTTSLGQDVFSQFIWGTRTTLIVGVGAGLLSTVIAILIGVTAGYVGGVVDSILNALCNIFLVMPGLALLIIIESYIHNTTPYMNGLIIALTGWAWGARVMRSMAMTIASRDYIAAARLSGMSTFRIILFEIVPNMTSVIASNVMYACLAAVLAESGLAYLGFENVASTSWGTMLYWATQNSALMSGAWWWFVPPGLGIALLGTSFALMNFGIDQVTNPRLRTSRRRRQVEKLLRELRAQNGEVKADGRDARTGASD

SEQ ID NO: 553 - protein, 331 aa, Artificial
  Substituion in SEQ ID NO 545
MTVAAIDVVDPRAKRASRRRNSALRQFFRNPKALAGVVLFGMFLVVAIFAPAIAPYNPTSTAFGMLQPPSHAHWFGTTSLGQDVFSQFIWGTRTTLIVGVGAGLLSTVIAILIGVTAGYVGGVVDSILNALCNIFLVMPGLALLIIIESYVHNTTPYMNGLIIALTGWAWGARVMRSMAMTIASRDYIAAARLSGMSTFRIILFEIVPNMTSVIASNVMYACLAAVLAESGLAYLGFENVASTSWGTMLYWATQNSALMSGAWWWFVPPGLGIALIGTSFALMNFGIDQVTNPRLRTSRRRRQVEKLLRELRAQNGEVKADGRDARTGASD

SEQ ID NO: 554 - protein, 331 aa, Artificial
  Substituion in SEQ ID NO 545
MTVAAIDVVDPRAKRASRRRNSALKQFFRNPKALAGVVLFGMFLVVAIFAPAIAPYNPTSTAFGMLQPPSHAHWFGTTSLGQDVFSQFIWGTRTTLIVGVGAGLLSTVIAILIGVTAGYVGGVVDSILNALCNIFLVMPGLALLIIIESYVHNTTPYMNGLIIALTGWAWGARVMRSMAMTIASRDYIAAARLSGMSTFRIILFEIVPNMTSVIASNVMYACLAAVLAESGLAYLGFENVASTSWGTMLYWATQNSALMSGAWWWFVPPGLGIALLGTSFALMNFGIDQVTNPRLRTSRRRRQVEKLLRELRAQNGEVKADGRDARTGASD

SEQ ID NO: 555 - protein, 331 aa, Artificial
  Substituion in SEQ ID NO 545
MTVAAIDVVDPRAKRASRRRNSALRQFFRNPKALAGVVLFGMFLVVAIFAPAIAPYNPTSTAFGMLQPPSHAHWFGTTSLGQDVFSQFIWGTRTTLIVGVGAGLLSTVIAILIGVTAGYVGGVVDSILNALCNIFLVMPGLALLIILESYVHNTTPYMNGLIIALTGWAWGARVMRSMAMTIASRDYIAAARLSGMSTFRIILFEIVPNMTSVIASNVMYACLAAVLAESGLAYLGFENVASTSWGTMLYWATQNSALMSGAWWWFVPPGLGIALLGTSFALMNFGIDQVTNPRLRTSRRRRQVEKLLRELRAQNGEVKADGRDARTGASD

SEQ ID NO: 556 - protein, 331 aa, Artificial
  Substituion in SEQ ID NO 545
MTVAAIDVVDPRAKRASRRRQSALRQFFRNPKALAGVVLFGMFLVVAIFAPAIAPYNPTSTAFGMLQPPSHAHWFGTTSLGQDVFSQFIWGTRTTLIVGVGAGLLSTVIAILIGVTAGYVGGVVDSILNALCNIFLVMPGLALLIIIESYVHNTTPYMNGLIIALTGWAWGARVMRSMAMTIASRDYIAAARLSGMSTFRIILFEIVPNMTSVIASNVMYACLAAVLAESGLAYLGFENVASTSWGTMLYWATQNSALMSGAWWWFVPPGLGIALLGTSFALMNFGIDQVTNPRLRTSRRRRQVEKLLRELRAQNGEVKADGRDARTGASD

SEQ ID NO: 557 - DNA, 996 bp, Artificial
  Substituion in SEQ ID NO 546
atgacagtcgcagccatcgatgtggtggatccgcgcgcgaagcgggcgagcaggcgcagaaactcggcgttgcgccagttctttcgaaatccgaaggcgctcgcgggcgtcgtcctgtttggcatgtttctggtggtggccatttttgcgcctgccatcgcgccctacaatccaacttccacggcgtttggcatgctgcaacctccgtcgcacgcgcactggttcggcacgacgagccttggccaggacgtgttttcacagttcatctggggcacgcggaccacgctcatcgtgggcgtcggagcggggcttttgagcaccgtgatcgccatcctgatcggcgtgacggcagggtatgtcggcggcgtggtcgattcaatcctaaacgcgctctgtaacattttcctcgtcatgccgggattggcgctgctcatcatcatcgaatcgtacattcacaacacgacgccgtatatgaacggtctgatcatcgcgctgacgggctgggcgtggggcgcgcgcgtgatgcggtccatggccatgaccattgcgagccgggattacatcgcggcggcgcgcctgtcggggatgtcgacgttccgcatcatcctgttcgagatcgtgccgaacatgacgagcgtcattgcctccaacgtgatgtacgcctgtctggcggcggtgctcgcggagtcgggcctcgcgtatctcgggttcgaaaatgtggcctcgacgagctggggcacgatgctgtactgggcgacgcagaacagcgcgctgatgagcggggcgtggtggtggttcgtgccgccggggctcggcatcgcgcttctcggcacgagctttgccctgatgaacttcggcatcgaccaggtcaccaacccgcgtctgcgcacgtcgcgcaggcgtcgacaggtcgagaaactgctgcgcgagcttcgggcgcagaacggtgaggtgaaggcggatggcagagacgcgagaaccggtgcttcagattga

SEQ ID NO: 558 - DNA, 996 bp, Artificial
  Substituion in SEQ ID NO 546
atgacagtcgcagccatcgatgtggtggatccgcgcgcgaagcgggcgagcaggcgcagaaactcggcgttgcgccagttctttcgaaatccgaaggcgctcgcgggcgtcgtcctgtttggcatgtttctggtggtggccatttttgcgcctgccatcgcgccctacaatccaacttccacggcgtttggcatgctgcaacctccgtcgcacgcgcactggttcggcacgacgagccttggccaggacgtgttttcacagttcatctggggcacgcggaccacgctcatcgtgggcgtcggagcggggcttttgagcaccgtgatcgccatcctgatcggcgtgacggcagggtatgtcggcggcgtggtcgattcaatcctaaacgcgctctgtaacattttcctcgtcatgccgggattggcgctgctcatcatcatcgaatcgtacgtgcacaacacgacgccgtatatgaacggtctgatcatcgcgctgacgggctgggcgtggggcgcgcgcgtgatgcggtccatggccatgaccattgcgagccgggattacatcgcggcggcgcgcctgtcggggatgtcgacgttccgcatcatcctgttcgagatcgtgccgaacatgacgagcgtcattgcctccaacgtgatgtacgcctgtctggcggcggtgctcgcggagtcgggcctcgcgtatctcgggttcgaaaatgtggcctcgacgagctggggcacgatgctgtactgggcgacgcagaacagcgcgctgatgagcggggcgtggtggtggttcgtgccgccggggctcggcatcgcgcttattggcacgagctttgccctgatgaacttcggcatcgaccaggtcaccaacccgcgtctgcgcacgtcgcgcaggcgtcgacaggtcgagaaactgctgcgcgagcttcgggcgcagaacggtgaggtgaaggcggatggcagagacgcgagaaccggtgcttcagattga

SEQ ID NO: 559 - DNA, 996 bp, Artificial
  Substituion in SEQ ID NO 546
atgacagtcgcagccatcgatgtggtggatccgcgcgcgaagcgggcgagcaggcgcagaaactcggcgttgaaacagttctttcgaaatccgaaggcgctcgcgggcgtcgtcctgtttggcatgtttctggtggtggccatttttgcgcctgccatcgcgccctacaatccaacttccacggcgtttggcatgctgcaacctccgtcgcacgcgcactggttcggcacgacgagccttggccaggacgtgttttcacagttcatctggggcacgcggaccacgctcatcgtgggcgtcggagcggggcttttgagcaccgtgatcgccatcctgatcggcgtgacggcagggtatgtcggcggcgtggtcgattcaatcctaaacgcgctctgtaacattttcctcgtcatgccgggattggcgctgctcatcatcatcgaatcgtacgtgcacaacacgacgccgtatatgaacggtctgatcatcgcgctgacgggctgggcgtggggcgcgcgcgtgatgcggtccatggccatgaccattgcgagccgggattacatcgcggcggcgcgcctgtcggggatgtcgacgttccgcatcatcctgttcgagatcgtgccgaacatgacgagcgtcattgcctccaacgtgatgtacgcctgtctggcggcggtgctcgcggagtcgggcctcgcgtatctcgggttcgaaaatgtggcctcgacgagctggggcacgatgctgtactgggcgacgcagaacagcgcgctgatgagcggggcgtggtggtggttcgtgccgccggggctcggcatcgcgcttctcggcacgagctttgccctgatgaacttcggcatcgaccaggtcaccaacccgcgtctgcgcacgtcgcgcaggcgtcgacaggtcgagaaactgctgcgcgagcttcgggcgcagaacggtgaggtgaaggcggatggcagagacgcgagaaccggtgcttcagattga

SEQ ID NO: 560 - DNA, 996 bp, Artificial
  Substituion in SEQ ID NO 546
atgacagtcgcagccatcgatgtggtggatccgcgcgcgaagcgggcgagcaggcgcagaaactcggcgttgcgccagttctttcgaaatccgaaggcgctcgcgggcgtcgtcctgtttggcatgtttctggtggtggccatttttgcgcctgccatcgcgccctacaatccaacttccacggcgtttggcatgctgcaacctccgtcgcacgcgcactggttcggcacgacgagccttggccaggacgtgttttcacagttcatctggggcacgcggaccacgctcatcgtgggcgtcggagcggggcttttgagcaccgtgatcgccatcctgatcggcgtgacggcagggtatgtcggcggcgtggtcgattcaatcctaaacgcgctctgtaacattttcctcgtcatgccgggattggcgctgctcatcatcttagaatcgtacgtgcacaacacgacgccgtatatgaacggtctgatcatcgcgctgacgggctgggcgtggggcgcgcgcgtgatgcggtccatggccatgaccattgcgagccgggattacatcgcggcggcgcgcctgtcggggatgtcgacgttccgcatcatcctgttcgagatcgtgccgaacatgacgagcgtcattgcctccaacgtgatgtacgcctgtctggcggcggtgctcgcggagtcgggcctcgcgtatctcgggttcgaaaatgtggcctcgacgagctggggcacgatgctgtactgggcgacgcagaacagcgcgctgatgagcggggcgtggtggtggttcgtgccgccggggctcggcatcgcgcttctcggcacgagctttgccctgatgaacttcggcatcgaccaggtcaccaacccgcgtctgcgcacgtcgcgcaggcgtcgacaggtcgagaaactgctgcgcgagcttcgggcgcagaacggtgaggtgaaggcggatggcagagacgcgagaaccggtgcttcagattga

SEQ ID NO: 561 - DNA, 996 bp, Artificial
  Substituion in SEQ ID NO 546
atgacagtcgcagccatcgatgtggtggatccgcgcgcgaagcgggcgagcaggcgcagacaatcggcgttgcgccagttctttcgaaatccgaaggcgctcgcgggcgtcgtcctgtttggcatgtttctggtggtggccatttttgcgcctgccatcgcgccctacaatccaacttccacggcgtttggcatgctgcaacctccgtcgcacgcgcactggttcggcacgacgagccttggccaggacgtgttttcacagttcatctggggcacgcggaccacgctcatcgtgggcgtcggagcggggcttttgagcaccgtgatcgccatcctgatcggcgtgacggcagggtatgtcggcggcgtggtcgattcaatcctaaacgcgctctgtaacattttcctcgtcatgccgggattggcgctgctcatcatcatcgaatcgtacgtgcacaacacgacgccgtatatgaacggtctgatcatcgcgctgacgggctgggcgtggggcgcgcgcgtgatgcggtccatggccatgaccattgcgagccgggattacatcgcggcggcgcgcctgtcggggatgtcgacgttccgcatcatcctgttcgagatcgtgccgaacatgacgagcgtcattgcctccaacgtgatgtacgcctgtctggcggcggtgctcgcggagtcgggcctcgcgtatctcgggttcgaaaatgtggcctcgacgagctggggcacgatgctgtactgggcgacgcagaacagcgcgctgatgagcggggcgtggtggtggttcgtgccgccggggctcggcatcgcgcttctcggcacgagctttgccctgatgaacttcggcatcgaccaggtcaccaacccgcgtctgcgcacgtcgcgcaggcgtcgacaggtcgagaaactgctgcgcgagcttcgggcgcagaacggtgaggtgaaggcggatggcagagacgcgagaaccggtgcttcagattga

SEQ ID NO: 562 - protein, 331 aa, Alicyclobacillus acidocaldarius
MAETREPVLQIEDLSVAYVTNTGLVHAVSDVNLTVHRGEIVGLVGESGSGKSTMAYTIMRLLRGDAVVTKGRVRVLGQDVYALSEKELRAFRWSKMSMVFQSAMSALNPVMTVETQIVDTILAHRPDLSRQAARERAKELLDLVRIDRKHLQSYPHELSGGMRQRVVIAIAIALNPALVIMDEPTTALDVVVQRSILDEIRRIQEQVGFAILFVSHDFSLVAELASRVAIMYAGRIVELTPSHLLNLSERHHPYTEGLLKAIPQLTADEVTIQGIGGYPPDLQDLPPGCAFHPRCPYAMDVCRRVRPAQVRAGEKVLECHLFNEAEVKAHV

SEQ ID NO: 563 - DNA, 996 bp, Alicyclobacillus acidocaldarius
atggcagagacgcgagaaccggtgcttcagattgaggacctgtccgtcgcctacgtgacgaacacggggctcgtgcacgcggtgagcgacgtgaacctgaccgtccatcggggcgagatcgtgggactggttggggagtcgggatcgggcaagtcgacgatggcgtacaccatcatgcggctgttgcgcggcgacgcggtggtcaccaagggccgcgtgcgggtgttgggccaggatgtgtacgcgctgtccgaaaaggaactgagggcgtttcgctggagcaagatgtccatggtgttccagagcgcgatgagcgccctgaacccggtgatgacggtggagacgcagatcgtcgacaccatcttggcacaccggccggatctgtcgcggcaggcggcgcgggagcgggcgaaggagttgctcgatctcgtccgaatcgaccggaaacacctgcagagctatccgcacgagctttccggcggcatgcgccagcgggtcgtgatcgccatcgcgattgcgctcaatcccgcgctcgtcatcatggatgagccgacgaccgcgcttgacgttgtggtgcagcggtccattctggacgaaatccggcgcatccaggagcaggtgggcttcgccatcttgtttgtcagccacgacttcagcctggtggcggagctcgcgtcccgcgtcgccatcatgtacgcgggccgcatcgtcgaactcacgccgagccacctgttgaacctgtccgagcggcaccacccgtacacggaggggctcctgaaggccattcctcagctgaccgcggacgaggtgaccatccaggggattggcggatacccaccggatctgcaggacctgccgcccggctgcgcgtttcatccgcgctgcccgtacgccatggacgtctgcaggcgcgtgcgcccggcgcaggtgcgggcgggcgagaaggtgctggagtgccacctgttcaacgaggcggaggtgaaggcccatgtctga

SEQ ID NO: 564 - protein, 315 aa, Sorangium cellulosum 'So ce 56'
PLLSVQDLRVEFITPTGPVCAVDNVSFDIAPGEVLGLAGESGSGKSTVAMAIMRLLRPPAVITGGHVYFAGQDVLAMNEEQLRAFRWRKMALVFQSAMTALNPVLTIGEQISDPIIAHDGVTPAQAMERAAALLKLVNIDSSRLNSYPHQLSGGMRQRVVIAIAMALKPPFLIMDEPTTALDVVVQREILQQIAELKERLGFSILFITHDLSLIAEFSTRIAILYAGKLAETARAKDLFSDPKHPYTQGLLGSFPSVRGPRRKLQGIPGSPPDMRNPPAGCRFHPRCPQAFATCQNELPVLREIAPEHRGACHLY

SEQ ID NO: 565 - protein, 317 aa, Herpetosiphon aurantiacus ATCC 23779
EPLLDVQNLSVEYQTLRGPVQAVSNVSFSIGQGEVFGLAGESGSGKSTIAHAIMRILHSPAVITGGNVLFDGDDVLEMDMEGLEAFRWRDISMVFQSAMNALNPVLTVGEQIIDVIQRHQPKTTKQQAKDRAAELLDIVGIDGKRVDDYPHQLSGGMRQRVVIAVALALKPQLMIMDEPTTALDVVVQKDIMQQIEYLKKELDFSILFITHDLSLMVEFSDRIGVMYAGEIVEMTAAHELFNKPMHPYTQGLMASFPALVGPKETLTGIPGSPPNMLEPPSGCRFHPRCPKAIAQCSLQQPTLREVEPGHFVACHLY

SEQ ID NO: 566 - protein, 324 aa, Vibrio sp. Ex25
PLISIRNLCVDYITDAGDVRACNNVSFDIAPGEVFGLAGESGCGKSTVAFSLMRLHKPPAFITGGEVIFNGEDIIKYSDERMQSFRWSEMSMVFQSAMNALNPVLTMEEQFCDVIMRHTNMTREQAKKRAEGLLEIVDIHPSRLNDYPHQFSGGMRQRLVIAIALALNPKMIIMDEPTTALDVVVQREILQKIYALKEEFGFSILFITHDLSLMVEFSDRIGIMYSGELIEVAPSKQILESPYHPYTKGLGSSFPPLTGPKTKLTGIPGNPLNLLEIPQGCRFQARCDRVHEACTRVPTQLRQIEPGRFSNCHLYGDTIAQAKV

SEQ ID NO: 567 - protein, 324 aa, Vibrio parahaemolyticus RIMD 2210633
PLISIRNLCVDYITDAGDVRACNNVSFDIAPGEVFGLAGESGCGKSTVAFSLMRLHKPPAFITGGEVIFNGEDILQYSDQRMQSFRWSEMSMVFQSAMNALNPVLTMEEQFCDVIMRHTGLTRAQARVRAEGLLEIVDIHPSRLSDYPHQFSGGMRQRLVIAIALALNPKMIIMDEPTTALDVVVQREILQKIYALKEEFGFSILFITHDLSLMVEFSDRIGIMYSGELIEVAPSKQILESPYHPYTKGLGSSFPPLTGPKTKLTGIPGNPLNLLEIPQGCRFQARCDRVHEACTRVPTQLRQIEPGRYSNCHLYGDTIAQAKV

SEQ ID NO: 568 - protein, 324 aa, Vibrio alginolyticus 12G01
PLISIRNLCVDYITDAGDVRACNNVSFDIAPGEVFGLAGESGCGKSTVAFSLMRLHKPPAFITGGEVIFNGEDILQYSDDRMQAFRWSEMSMVFQSAMNALNPVLTMEEQFCDVIMRHTNMTRAQAKTRAEGLLEIVDIHPSRLSDYPHQFSGGMRQRLVIAIALALNPKMIIMDEPTTALDVVVQREILQKIYALKEEFGFSILFITHDLSLMVEFSDRIGIMYSGELIEVAPSKQILESPYHPYTKGLGSSFPPLTGPKTKLTGIPGNPLNLLEVPRGCRFQARCDRVHEACTRVPTQLRQIEPGRLSNCHLYGDTIAQAKV

SEQ ID NO: 569 - protein, 331 aa, Artificial
  Substituion in SEQ ID NO 562
MAETREPVLQIEDLSVAYVTNTGLVHAVSDVNLTVHRGEIVGLVGESGSGKSTMAYTIMRLLRGDAVVTKGRVRVLGQDVYALSEKELRAFRWSKMSMVFQSAMSALNPVMTVETQIVDTILAHRPDLSRQAARERAKELLDLVRIDRKHLQSYPHELSGGMRQRIVIAIAIALNPALVIMDEPTTALDVVVQRSILDEIRRIQEQVGFAILFVSHDFSLVAELASRVAIMYAGRIVELTPSHLLNLSERHHPYTEGLLKAIPQLTADEVTIQGIGGYPPDLQDLPPGCAFHPRCPYAMDVCRRVRPAQVRAGEKVLECHLFNEAEVKAHV

SEQ ID NO: 570 - protein, 331 aa, Artificial
  Substituion in SEQ ID NO 562
MAETREPVLQIEDLSVAYVTNTGLVHAVSDVNLTVHRGELVGLVGESGSGKSTMAYTIMRLLRGDAVVTKGRVRVLGQDVYALSEKELRAFRWSKMSMVFQSAMSALNPVMTVETQIVDTILAHRPDLSRQAARERAKELLDLVRIDRKHLQSYPHELSGGMRQRVVIAIAIALNPALVIMDEPTTALDVVVQRSILDEIRRIQEQVGFAILFVSHDFSLVAELASRVAIMYAGRIVELTPSHLLNLSERHHPYTEGLLKAIPQLTADEVTIQGIGGYPPDLQDLPPGCAFHPRCPYAMDVCRRVRPAQVRAGEKVLECHLFNEAEVKAHV

SEQ ID NO: 571 - protein, 331 aa, Artificial
  Substituion in SEQ ID NO 562
MAETREPVLQIEDLSVAYVTNTGLVHAVSDVNLTVHRGEIVGLVGESGSGKSTMAYTIMRLLRGDAVVTKGRVRVLGQDVYALSEKELRAFRWSKMSMVFQSAMSALNPVMTVETQIVDTILAHRPDLSRQAARERAKELLDLVRIDRKHLQSYPHELSGGMRQRVVIAIAIALNPALVIMDEPTTALDVVVQRSILDEIRRIQEQVGFAILFVSHDFSLVAELASRVAIMYAGRIVELTPSHLLNLSERHHPYTEGLLKAIPQLTADEITIQGIGGYPPDLQDLPPGCAFHPRCPYAMDVCRRVRPAQVRAGEKVLECHLFNEAEVKAHV

SEQ ID NO: 572 - protein, 331 aa, Artificial
  Substituion in SEQ ID NO 562
MAETREPVLQLEDLSVAYVTNTGLVHAVSDVNLTVHRGEIVGLVGESGSGKSTMAYTIMRLLRGDAVVTKGRVRVLGQDVYALSEKELRAFRWSKMSMVFQSAMSALNPVMTVETQIVDTILAHRPDLSRQAARERAKELLDLVRIDRKHLQSYPHELSGGMRQRVVIAIAIALNPALVIMDEPTTALDVVVQRSILDEIRRIQEQVGFAILFVSHDFSLVAELASRVAIMYAGRIVELTPSHLLNLSERHHPYTEGLLKAIPQLTADEVTIQGIGGYPPDLQDLPPGCAFHPRCPYAMDVCRRVRPAQVRAGEKVLECHLFNEAEVKAHV

SEQ ID NO: 573 - protein, 331 aa, Artificial
  Substituion in SEQ ID NO 562
MAETREPVLQIEDLSVAYVTNTGLVHAVSDVNLTVHRGEIVGLVGESGSGKSTMAYTIMRLLRGDAVVTKGRVRVLGQDVYALSEKEIRAFRWSKMSMVFQSAMSALNPVMTVETQIVDTILAHRPDLSRQAARERAKELLDLVRIDRKHLQSYPHELSGGMRQRVVIAIAIALNPALVIMDEPTTALDVVVQRSILDEIRRIQEQVGFAILFVSHDFSLVAELASRVAIMYAGRIVELTPSHLLNLSERHHPYTEGLLKAIPQLTADEVTIQGIGGYPPDLQDLPPGCAFHPRCPYAMDVCRRVRPAQVRAGEKVLECHLFNEAEVKAHV

SEQ ID NO: 574 - DNA, 996 bp, Artificial
  Substituion in SEQ ID NO 563
atggcagagacgcgagaaccggtgcttcagattgaggacctgtccgtcgcctacgtgacgaacacggggctcgtgcacgcggtgagcgacgtgaacctgaccgtccatcggggcgagatcgtgggactggttggggagtcgggatcgggcaagtcgacgatggcgtacaccatcatgcggctgttgcgcggcgacgcggtggtcaccaagggccgcgtgcgggtgttgggccaggatgtgtacgcgctgtccgaaaaggaactgagggcgtttcgctggagcaagatgtccatggtgttccagagcgcgatgagcgccctgaacccggtgatgacggtggagacgcagatcgtcgacaccatcttggcacaccggccggatctgtcgcggcaggcggcgcgggagcgggcgaaggagttgctcgatctcgtccgaatcgaccggaaacacctgcagagctatccgcacgagctttccggcggcatgcgccagcggattgtgatcgccatcgcgattgcgctcaatcccgcgctcgtcatcatggatgagccgacgaccgcgcttgacgttgtggtgcagcggtccattctggacgaaatccggcgcatccaggagcaggtgggcttcgccatcttgtttgtcagccacgacttcagcctggtggcggagctcgcgtcccgcgtcgccatcatgtacgcgggccgcatcgtcgaactcacgccgagccacctgttgaacctgtccgagcggcaccacccgtacacggaggggctcctgaaggccattcctcagctgaccgcggacgaggtgaccatccaggggattggcggatacccaccggatctgcaggacctgccgcccggctgcgcgtttcatccgcgctgcccgtacgccatggacgtctgcaggcgcgtgcgcccggcgcaggtgcgggcgggcgagaaggtgctggagtgccacctgttcaacgaggcggaggtgaaggcccatgtctga

SEQ ID NO: 575 - DNA, 996 bp, Artificial
  Substituion in SEQ ID NO 563
atggcagagacgcgagaaccggtgcttcagattgaggacctgtccgtcgcctacgtgacgaacacggggctcgtgcacgcggtgagcgacgtgaacctgaccgtccatcggggcgagttagtgggactggttggggagtcgggatcgggcaagtcgacgatggcgtacaccatcatgcggctgttgcgcggcgacgcggtggtcaccaagggccgcgtgcgggtgttgggccaggatgtgtacgcgctgtccgaaaaggaactgagggcgtttcgctggagcaagatgtccatggtgttccagagcgcgatgagcgccctgaacccggtgatgacggtggagacgcagatcgtcgacaccatcttggcacaccggccggatctgtcgcggcaggcggcgcgggagcgggcgaaggagttgctcgatctcgtccgaatcgaccggaaacacctgcagagctatccgcacgagctttccggcggcatgcgccagcgggtcgtgatcgccatcgcgattgcgctcaatcccgcgctcgtcatcatggatgagccgacgaccgcgcttgacgttgtggtgcagcggtccattctggacgaaatccggcgcatccaggagcaggtgggcttcgccatcttgtttgtcagccacgacttcagcctggtggcggagctcgcgtcccgcgtcgccatcatgtacgcgggccgcatcgtcgaactcacgccgagccacctgttgaacctgtccgagcggcaccacccgtacacggaggggctcctgaaggccattcctcagctgaccgcggacgaggtgaccatccaggggattggcggatacccaccggatctgcaggacctgccgcccggctgcgcgtttcatccgcgctgcccgtacgccatggacgtctgcaggcgcgtgcgcccggcgcaggtgcgggcgggcgagaaggtgctggagtgccacctgttcaacgaggcggaggtgaaggcccatgtctga

SEQ ID NO: 576 - DNA, 996 bp, Artificial
  Substituion in SEQ ID NO 563
atggcagagacgcgagaaccggtgcttcagattgaggacctgtccgtcgcctacgtgacgaacacggggctcgtgcacgcggtgagcgacgtgaacctgaccgtccatcggggcgagatcgtgggactggttggggagtcgggatcgggcaagtcgacgatggcgtacaccatcatgcggctgttgcgcggcgacgcggtggtcaccaagggccgcgtgcgggtgttgggccaggatgtgtacgcgctgtccgaaaaggaactgagggcgtttcgctggagcaagatgtccatggtgttccagagcgcgatgagcgccctgaacccggtgatgacggtggagacgcagatcgtcgacaccatcttggcacaccggccggatctgtcgcggcaggcggcgcgggagcgggcgaaggagttgctcgatctcgtccgaatcgaccggaaacacctgcagagctatccgcacgagctttccggcggcatgcgccagcgggtcgtgatcgccatcgcgattgcgctcaatcccgcgctcgtcatcatggatgagccgacgaccgcgcttgacgttgtggtgcagcggtccattctggacgaaatccggcgcatccaggagcaggtgggcttcgccatcttgtttgtcagccacgacttcagcctggtggcggagctcgcgtcccgcgtcgccatcatgtacgcgggccgcatcgtcgaactcacgccgagccacctgttgaacctgtccgagcggcaccacccgtacacggaggggctcctgaaggccattcctcagctgaccgcggacgagattaccatccaggggattggcggatacccaccggatctgcaggacctgccgcccggctgcgcgtttcatccgcgctgcccgtacgccatggacgtctgcaggcgcgtgcgcccggcgcaggtgcgggcgggcgagaaggtgctggagtgccacctgttcaacgaggcggaggtgaaggcccatgtctga

SEQ ID NO: 577 - DNA, 996 bp, Artificial
  Substituion in SEQ ID NO 563
atggcagagacgcgagaaccggtgcttcagttagaggacctgtccgtcgcctacgtgacgaacacggggctcgtgcacgcggtgagcgacgtgaacctgaccgtccatcggggcgagatcgtgggactggttggggagtcgggatcgggcaagtcgacgatggcgtacaccatcatgcggctgttgcgcggcgacgcggtggtcaccaagggccgcgtgcgggtgttgggccaggatgtgtacgcgctgtccgaaaaggaactgagggcgtttcgctggagcaagatgtccatggtgttccagagcgcgatgagcgccctgaacccggtgatgacggtggagacgcagatcgtcgacaccatcttggcacaccggccggatctgtcgcggcaggcggcgcgggagcgggcgaaggagttgctcgatctcgtccgaatcgaccggaaacacctgcagagctatccgcacgagctttccggcggcatgcgccagcgggtcgtgatcgccatcgcgattgcgctcaatcccgcgctcgtcatcatggatgagccgacgaccgcgcttgacgttgtggtgcagcggtccattctggacgaaatccggcgcatccaggagcaggtgggcttcgccatcttgtttgtcagccacgacttcagcctggtggcggagctcgcgtcccgcgtcgccatcatgtacgcgggccgcatcgtcgaactcacgccgagccacctgttgaacctgtccgagcggcaccacccgtacacggaggggctcctgaaggccattcctcagctgaccgcggacgaggtgaccatccaggggattggcggatacccaccggatctgcaggacctgccgcccggctgcgcgtttcatccgcgctgcccgtacgccatggacgtctgcaggcgcgtgcgcccggcgcaggtgcgggcgggcgagaaggtgctggagtgccacctgttcaacgaggcggaggtgaaggcccatgtctga

SEQ ID NO: 578 - DNA, 996 bp, Artificial
  Substituion in SEQ ID NO 563
atggcagagacgcgagaaccggtgcttcagattgaggacctgtccgtcgcctacgtgacgaacacggggctcgtgcacgcggtgagcgacgtgaacctgaccgtccatcggggcgagatcgtgggactggttggggagtcgggatcgggcaagtcgacgatggcgtacaccatcatgcggctgttgcgcggcgacgcggtggtcaccaagggccgcgtgcgggtgttgggccaggatgtgtacgcgctgtccgaaaaggaaattagggcgtttcgctggagcaagatgtccatggtgttccagagcgcgatgagcgccctgaacccggtgatgacggtggagacgcagatcgtcgacaccatcttggcacaccggccggatctgtcgcggcaggcggcgcgggagcgggcgaaggagttgctcgatctcgtccgaatcgaccggaaacacctgcagagctatccgcacgagctttccggcggcatgcgccagcgggtcgtgatcgccatcgcgattgcgctcaatcccgcgctcgtcatcatggatgagccgacgaccgcgcttgacgttgtggtgcagcggtccattctggacgaaatccggcgcatccaggagcaggtgggcttcgccatcttgtttgtcagccacgacttcagcctggtggcggagctcgcgtcccgcgtcgccatcatgtacgcgggccgcatcgtcgaactcacgccgagccacctgttgaacctgtccgagcggcaccacccgtacacggaggggctcctgaaggccattcctcagctgaccgcggacgaggtgaccatccaggggattggcggatacccaccggatctgcaggacctgccgcccggctgcgcgtttcatccgcgctgcccgtacgccatggacgtctgcaggcgcgtgcgcccggcgcaggtgcgggcgggcgagaaggtgctggagtgccacctgttcaacgaggcggaggtgaaggcccatgtctga

SEQ ID NO: 579 - protein, 352 aa, Alicyclobacillus acidocaldarius
MKLRTKKAKHKALGGLAAAALVATVTGCGTVATTASTPNSNAGSAAASSSKPIKVAFIPKEIGIPYFTGADQGAQSVAPKLHIQLTYNGPTQASAADQVSMINSYVAQGYNVIAVSANDPTSLAPALESAMRRGVKVITWDSDVIPSARQFFVDQATAQGIGTTLVQITAEHFKSQKNVEVGILSSTPTNPNQNAWIAVMKQAIQSKYKNLHIVTIQYDQEQPDVGLTAAENMLRAYPQMKAIISPDSVGVPAAAEAVEKLGLKGKVFVTGLADPIQMKQYVNDGTVQEFVLWDVPKLGALTMYVARAVVDGTMPVNGTFKCALGSFKVQNRVVLLGNPTIFNKSNINNANY

SEQ ID NO: 580 - DNA, 1059 bp, Alicyclobacillus acidocaldarius
atgaagctccgcacgaaaaaggcgaaacacaaggctctgggtggattggcagccgcagcgctcgtggccactgtgacggggtgtggtactgtcgcgaccaccgcgtccacgcccaattcgaatgccgggagcgcagcagcctcgtcgtccaaaccgatcaaggttgcctttatcccgaaggaaatcggcataccgtacttcacaggcgcggatcaaggggcccaatctgttgcaccgaagcttcacattcaactcacgtataacgggccgacgcaggcaagcgcagctgatcaggtttcgatgatcaacagctacgttgcccaaggttacaacgtcattgctgtgtccgcgaatgatcccacttctttggccccagcgttggaatctgcaatgcgcaggggcgtgaaggtcattacgtgggactctgatgtcatcccgtcggcgcgccagttctttgtcgaccaggcgacagcgcaaggcattggcaccactcttgtacagatcacggcggaacattttaagagccagaagaatgtcgaggttggcattctgtcgtccaccccgacaaatccgaatcagaacgcctggatcgcggtcatgaaacaggcgattcagagcaagtacaagaacttgcatatcgtaaccattcagtacgatcaggagcaacctgacgtgggattgacggccgctgaaaacatgttgcgagcctatccacagatgaaggcgataatatctccggattctgttggagtccctgctgcagcagaagccgtcgaaaaactgggccttaagggtaaagtgttcgttaccggactcgcggatccaattcaaatgaagcaatatgtgaatgacgggactgtccaggaattcgtgctgtgggacgtgccgaaactgggtgctctcaccatgtatgtcgctcgggccgtggtagatggtacaatgcctgtaaacggcacgttcaagtgtgcgttgggttcgttcaaggtgcaaaatagagttgtacttttgggcaatccaacaatatttaacaaatcgaacatcaacaatgcgaattactga

SEQ ID NO: 581 - protein, 301 aa, Rubrobacter xylanophilus DSM 9941
PNKICMMPKLVGIPYFNAAEKGAREAARELGVDLVYDGPTEALAADQVEFIEQFIQQQCDAITVAANDPDALAPAMKKAKQAGIATGAWDADVAEDARDVFVNQATFQAIGYKLVDVMAEQTGGKGKFLVVTGSLTAPNQNAWLKEMRERMRQKYPQMEIASVQPGEEDLQKGIDITKDYLRANPDTAGVFGITSVALPGAAEAVQQMGLKGEVAVTGLSTPNEMKPYVKSGVVEKFVLWNPVDLGYLAVYVANAQVEGTLPESGTFKAGRLGEVKMLAPDEVLLGPPLVFTRENIDEYDF

SEQ ID NO: 582 - protein, 312 aa, Haemophilus somnus 2336
KVAFIPKLVGVGFFTSGGQGAVEMGKKLGLDVTYDGPAEPSVSNQVQMINNFVNQGYNAIIVSAVSPDGLCSTLKRAMKKGVKVLTWDSDTQPECRSYYINQGTPTQLGSMLVEMVSSQISKPKAKVAFFYSSPTVTDQNQWVKEAKAKIEKEHPKWEIVTTQFGYNDAIKSLQTAEGILKAYPDLDAIIAPDANALPAAAQAVENLKRQGTIVVGFSTPNVMRPYVKRGTVNQFGLWDVVKQGQLSVAVANELLKGNSLKVGDKLNVDGIGEVEVSANKVQGYEFEAKGNGIVLLPERVVFTKDNIDNYDF

SEQ ID NO: 583 - protein, 312 aa, Klebsiella pneumoniae subsp. pneumoniae MGH 78578
RIAFIPKLVGVGFFTSGGNGAKEAGKALGVDVTYDGPTEPSVSGQVQLINNFVNQGYNAIIVSAVSPDGLCPALKRAMQRGVKVLTWDSDTKPECRSIYINQGTPQQLGGLLVEMAEKQVSKPAAKVAFFYSSPTVTDQNQWVKEAKAKIEKEHPQWQIVTTQFGYNDATKSLQTAEGILKAYPDLDAIIAPDANALPAAAQAAENLKRQGVAIVGFSTPNVMRPYVERGTVKAFGLWDVVKQGKIAVNVADRLLKKGDLNVGDSVEVKDIGSLKVEPNSVQGYQYEAKGNGIVLLPERVVFSKENINNYDF

SEQ ID NO: 584 - protein, 312 aa, Salmonella enterica subsp. enterica serovar Paratyphi B str. SPB7
RIAFIPKLVGVGFFTSGGNGAQEAGKALGIDVTYDGPTEPSVSGQVQLVNNFVNQGYDAIIVSAVSPDGLCPALKRAMQRGVKILTWDSDTKPECRSYYINQGTPKQLGSMLVEMAAHQVDKEKAKVAFFYSSPTVTDQNQWVKEAKAKISQEHPGWEIVTTQFGYNDATKSLQTAEGIIKAYPDLDAIIAPDANALPAAAQAAENLKRNNLAIVGFSTPNVMRPYVQRGTVKEFGLWDVVQQGKISVYVANALLKNMPMNVGDSLDIPGIGKVTVSPNSEQGYHYEAKGNGIVLLPERVIFNKNNIDKYDF

SEQ ID NO: 585 - protein, 314 aa, Rhodobacter sphaeroides 2.4.1
EIAFIPKLVGVGFFTSGGNGAMKMGEELGVKVTYDGPTEPSVSGQVQFVNNFVNQGYGAIVLSSVSPDGLCPALKQAMARDVLVMTWDSDVNPDCRSYYINQGTPEQLGGLLVDMANDGLEGKEKAKVAFFYSSPTVTDQNAWAEAAKARIAADHPGWEIVTTQYGYNDAQKSLQTAESILSAYPDLDAIIAPDANALPASAQAAENLGRAGEVTIVGFSTPNVMRPYVKRGTVERFGLWDVTQQGAISVAVAAHVLKDGPLNVGDSLEVPGIGSVEVSPNSVQGYDYEAEGNGIILLPERTVFTAENIDNFDF

SEQ ID NO: 586 - protein, 352 aa, Artificial
  Substituion in SEQ ID NO 579
MKLRTKKAKHKALGGLAAAALVATVTGCGTVATTASTPNSNAGSAAASSSKPIKVAFIPKEIGIPYFTGADQGAQSVAPKLHIQLTYNGPTNASAADQVSMINSYVAQGYNVIAVSANDPTSLAPALESAMRRGVKVITWDSDVIPSARQFFVDQATAQGIGTTLVQITAEHFKSQKNVEVGILSSTPTNPNQNAWIAVMKQAIQSKYKNLHIVTIQYDQEQPDVGLTAAENMLRAYPQMKAIISPDSVGVPAAAEAVEKLGLKGKVFVTGLADPIQMKQYVNDGTVQEFVLWDVPKLGALTMYVARAVVDGTMPVNGTFKCALGSFKVQNRVVLLGNPTIFNKSNINNANY

SEQ ID NO: 587 - protein, 352 aa, Artificial
  Substituion in SEQ ID NO 579
MKLRTKKAKHKALGGLAAAALVATVTGCGTVATTASTPNSNAGSAAASSSKPIKVAFIPKEIGIPYFTGADQGAQSVAPKLHIQLTYNGPTQASAADQVSMIQSYVAQGYNVIAVSANDPTSLAPALESAMRRGVKVITWDSDVIPSARQFFVDQATAQGIGTTLVQITAEHFKSQKNVEVGILSSTPTNPNQNAWIAVMKQAIQSKYKNLHIVTIQYDQEQPDVGLTAAENMLRAYPQMKAIISPDSVGVPAAAEAVEKLGLKGKVFVTGLADPIQMKQYVNDGTVQEFVLWDVPKLGALTMYVARAVVDGTMPVNGTFKCALGSFKVQNRVVLLGNPTIFNKSNINNANY

SEQ ID NO: 588 - protein, 352 aa, Artificial
  Substituion in SEQ ID NO 579
MKLRTKKAKHKALGGLAAAALVATVTGCGTVATTASTPNSNAGSAAASSSKPIKVAFIPKEIGIPYFTGADQGAQSVAPKLHIQLTYNGPTQASAADQVSMINSYVAQGYNVIAVSANDPTSLAPALESAMRRGVKVITWDSDVIPSARQFFVDQATAQGIGTTLVQITADHFKSQKNVEVGILSSTPTNPNQNAWIAVMKQAIQSKYKNLHIVTIQYDQEQPDVGLTAAENMLRAYPQMKAIISPDSVGVPAAAEAVEKLGLKGKVFVTGLADPIQMKQYVNDGTVQEFVLWDVPKLGALTMYVARAVVDGTMPVNGTFKCALGSFKVQNRVVLLGNPTIFNKSNINNANY

SEQ ID NO: 589 - protein, 352 aa, Artificial
  Substituion in SEQ ID NO 579
MKLRTKKAKHKALGGLAAAALVATVTGCGTVATTASTPNSNAGSAAASSSKPIKVAFIPKEIGIPYFTGADQGAQSVAPKLHIQLTYNGPTQASAADQVSMINSYVAQGYNVIAVSANDPTSLAPALESAMRRGVKVITWDSDVIPSARQFFVDQATAQGIGTTLVQITAEHFKSQKNVEVGILSSTPTNPNQNAWIAVMKQAIQSKYKNLHIVTIQYDQEQPDVGLTAAENMLRAYPQMKAIISPDSVGVPAAAEAVEKLGLKGKVFITGLADPIQMKQYVNDGTVQEFVLWDVPKLGALTMYVARAVVDGTMPVNGTFKCALGSFKVQNRVVLLGNPTIFNKSNINNANY

SEQ ID NO: 590 - protein, 352 aa, Artificial
  Substituion in SEQ ID NO 579
MKLRTKKAKHKALGGLAAAALVATVTGCGTVATTASTPNSNAGSAAASSSKPIKVAFIPKEIGIPYFTGADQGAQSVAPKLHIQITYNGPTQASAADQVSMINSYVAQGYNVIAVSANDPTSLAPALESAMRRGVKVITWDSDVIPSARQFFVDQATAQGIGTTLVQITAEHFKSQKNVEVGILSSTPTNPNQNAWIAVMKQAIQSKYKNLHIVTIQYDQEQPDVGLTAAENMLRAYPQMKAIISPDSVGVPAAAEAVEKLGLKGKVFVTGLADPIQMKQYVNDGTVQEFVLWDVPKLGALTMYVARAVVDGTMPVNGTFKCALGSFKVQNRVVLLGNPTIFNKSNINNANY

SEQ ID NO: 591 - DNA, 1059 bp, Artificial
  Substituion in SEQ ID NO 580
atgaagctccgcacgaaaaaggcgaaacacaaggctctgggtggattggcagccgcagcgctcgtggccactgtgacggggtgtggtactgtcgcgaccaccgcgtccacgcccaattcgaatgccgggagcgcagcagcctcgtcgtccaaaccgatcaaggttgcctttatcccgaaggaaatcggcataccgtacttcacaggcgcggatcaaggggcccaatctgttgcaccgaagcttcacattcaactcacgtataacgggccgacgaatgcaagcgcagctgatcaggtttcgatgatcaacagctacgttgcccaaggttacaacgtcattgctgtgtccgcgaatgatcccacttctttggccccagcgttggaatctgcaatgcgcaggggcgtgaaggtcattacgtgggactctgatgtcatcccgtcggcgcgccagttctttgtcgaccaggcgacagcgcaaggcattggcaccactcttgtacagatcacggcggaacattttaagagccagaagaatgtcgaggttggcattctgtcgtccaccccgacaaatccgaatcagaacgcctggatcgcggtcatgaaacaggcgattcagagcaagtacaagaacttgcatatcgtaaccattcagtacgatcaggagcaacctgacgtgggattgacggccgctgaaaacatgttgcgagcctatccacagatgaaggcgataatatctccggattctgttggagtccctgctgcagcagaagccgtcgaaaaactgggccttaagggtaaagtgttcgttaccggactcgcggatccaattcaaatgaagcaatatgtgaatgacgggactgtccaggaattcgtgctgtgggacgtgccgaaactgggtgctctcaccatgtatgtcgctcgggccgtggtagatggtacaatgcctgtaaacggcacgttcaagtgtgcgttgggttcgttcaaggtgcaaaatagagttgtacttttgggcaatccaacaatatttaacaaatcgaacatcaacaatgcgaattactga

SEQ ID NO: 592 - DNA, 1059 bp, Artificial
  Substituion in SEQ ID NO 580
atgaagctccgcacgaaaaaggcgaaacacaaggctctgggtggattggcagccgcagcgctcgtggccactgtgacggggtgtggtactgtcgcgaccaccgcgtccacgcccaattcgaatgccgggagcgcagcagcctcgtcgtccaaaccgatcaaggttgcctttatcccgaaggaaatcggcataccgtacttcacaggcgcggatcaaggggcccaatctgttgcaccgaagcttcacattcaactcacgtataacgggccgacgcaggcaagcgcagctgatcaggtttcgatgatccaaagctacgttgcccaaggttacaacgtcattgctgtgtccgcgaatgatcccacttctttggccccagcgttggaatctgcaatgcgcaggggcgtgaaggtcattacgtgggactctgatgtcatcccgtcggcgcgccagttctttgtcgaccaggcgacagcgcaaggcattggcaccactcttgtacagatcacggcggaacattttaagagccagaagaatgtcgaggttggcattctgtcgtccaccccgacaaatccgaatcagaacgcctggatcgcggtcatgaaacaggcgattcagagcaagtacaagaacttgcatatcgtaaccattcagtacgatcaggagcaacctgacgtgggattgacggccgctgaaaacatgttgcgagcctatccacagatgaaggcgataatatctccggattctgttggagtccctgctgcagcagaagccgtcgaaaaactgggccttaagggtaaagtgttcgttaccggactcgcggatccaattcaaatgaagcaatatgtgaatgacgggactgtccaggaattcgtgctgtgggacgtgccgaaactgggtgctctcaccatgtatgtcgctcgggccgtggtagatggtacaatgcctgtaaacggcacgttcaagtgtgcgttgggttcgttcaaggtgcaaaatagagttgtacttttgggcaatccaacaatatttaacaaatcgaacatcaacaatgcgaattactga

SEQ ID NO: 593 - DNA, 1059 bp, Artificial
  Substituion in SEQ ID NO 580
atgaagctccgcacgaaaaaggcgaaacacaaggctctgggtggattggcagccgcagcgctcgtggccactgtgacggggtgtggtactgtcgcgaccaccgcgtccacgcccaattcgaatgccgggagcgcagcagcctcgtcgtccaaaccgatcaaggttgcctttatcccgaaggaaatcggcataccgtacttcacaggcgcggatcaaggggcccaatctgttgcaccgaagcttcacattcaactcacgtataacgggccgacgcaggcaagcgcagctgatcaggtttcgatgatcaacagctacgttgcccaaggttacaacgtcattgctgtgtccgcgaatgatcccacttctttggccccagcgttggaatctgcaatgcgcaggggcgtgaaggtcattacgtgggactctgatgtcatcccgtcggcgcgccagttctttgtcgaccaggcgacagcgcaaggcattggcaccactcttgtacagatcacggcggatcattttaagagccagaagaatgtcgaggttggcattctgtcgtccaccccgacaaatccgaatcagaacgcctggatcgcggtcatgaaacaggcgattcagagcaagtacaagaacttgcatatcgtaaccattcagtacgatcaggagcaacctgacgtgggattgacggccgctgaaaacatgttgcgagcctatccacagatgaaggcgataatatctccggattctgttggagtccctgctgcagcagaagccgtcgaaaaactgggccttaagggtaaagtgttcgttaccggactcgcggatccaattcaaatgaagcaatatgtgaatgacgggactgtccaggaattcgtgctgtgggacgtgccgaaactgggtgctctcaccatgtatgtcgctcgggccgtggtagatggtacaatgcctgtaaacggcacgttcaagtgtgcgttgggttcgttcaaggtgcaaaatagagttgtacttttgggcaatccaacaatatttaacaaatcgaacatcaacaatgcgaattactga

SEQ ID NO: 594 - DNA, 1059 bp, Artificial
  Substituion in SEQ ID NO 580
atgaagctccgcacgaaaaaggcgaaacacaaggctctgggtggattggcagccgcagcgctcgtggccactgtgacggggtgtggtactgtcgcgaccaccgcgtccacgcccaattcgaatgccgggagcgcagcagcctcgtcgtccaaaccgatcaaggttgcctttatcccgaaggaaatcggcataccgtacttcacaggcgcggatcaaggggcccaatctgttgcaccgaagcttcacattcaactcacgtataacgggccgacgcaggcaagcgcagctgatcaggtttcgatgatcaacagctacgttgcccaaggttacaacgtcattgctgtgtccgcgaatgatcccacttctttggccccagcgttggaatctgcaatgcgcaggggcgtgaaggtcattacgtgggactctgatgtcatcccgtcggcgcgccagttctttgtcgaccaggcgacagcgcaaggcattggcaccactcttgtacagatcacggcggaacattttaagagccagaagaatgtcgaggttggcattctgtcgtccaccccgacaaatccgaatcagaacgcctggatcgcggtcatgaaacaggcgattcagagcaagtacaagaacttgcatatcgtaaccattcagtacgatcaggagcaacctgacgtgggattgacggccgctgaaaacatgttgcgagcctatccacagatgaaggcgataatatctccggattctgttggagtccctgctgcagcagaagccgtcgaaaaactgggccttaagggtaaagtgttcattaccggactcgcggatccaattcaaatgaagcaatatgtgaatgacgggactgtccaggaattcgtgctgtgggacgtgccgaaactgggtgctctcaccatgtatgtcgctcgggccgtggtagatggtacaatgcctgtaaacggcacgttcaagtgtgcgttgggttcgttcaaggtgcaaaatagagttgtacttttgggcaatccaacaatatttaacaaatcgaacatcaacaatgcgaattactga

SEQ ID NO: 595 - DNA, 1059 bp, Artificial
  Substituion in SEQ ID NO 580
atgaagctccgcacgaaaaaggcgaaacacaaggctctgggtggattggcagccgcagcgctcgtggccactgtgacggggtgtggtactgtcgcgaccaccgcgtccacgcccaattcgaatgccgggagcgcagcagcctcgtcgtccaaaccgatcaaggttgcctttatcccgaaggaaatcggcataccgtacttcacaggcgcggatcaaggggcccaatctgttgcaccgaagcttcacattcaaattacgtataacgggccgacgcaggcaagcgcagctgatcaggtttcgatgatcaacagctacgttgcccaaggttacaacgtcattgctgtgtccgcgaatgatcccacttctttggccccagcgttggaatctgcaatgcgcaggggcgtgaaggtcattacgtgggactctgatgtcatcccgtcggcgcgccagttctttgtcgaccaggcgacagcgcaaggcattggcaccactcttgtacagatcacggcggaacattttaagagccagaagaatgtcgaggttggcattctgtcgtccaccccgacaaatccgaatcagaacgcctggatcgcggtcatgaaacaggcgattcagagcaagtacaagaacttgcatatcgtaaccattcagtacgatcaggagcaacctgacgtgggattgacggccgctgaaaacatgttgcgagcctatccacagatgaaggcgataatatctccggattctgttggagtccctgctgcagcagaagccgtcgaaaaactgggccttaagggtaaagtgttcgttaccggactcgcggatccaattcaaatgaagcaatatgtgaatgacgggactgtccaggaattcgtgctgtgggacgtgccgaaactgggtgctctcaccatgtatgtcgctcgggccgtggtagatggtacaatgcctgtaaacggcacgttcaagtgtgcgttgggttcgttcaaggtgcaaaatagagttgtacttttgggcaatccaacaatatttaacaaatcgaacatcaacaatgcgaattactga

SEQ ID NO: 596 - protein, 337 aa, Alicyclobacillus acidocaldarius
MRGVAENRIWSLAIAGLLILEIGFFGVLSPDFVSPQNLLASTENFLPVGFMALSMTLVIITGGIDLSVGSMMSLCGVVMGLLWQHGVNIWLAALLSILLGALLGFINGQLIVRTGIQPLIATLATLFIYGSLAMVLVGQGEGSIYGFPQSYLSLGTGTVLKWIPIQLIFYGVVACLFGFLLKYTSYGRQVYFVGNNEGAALYSGLQVNRVKTITYVLSGCMSGVAAVFMGAYFASVRGDMGTNYELSVITSCLVGGVNVFGGSGTILGAFLGTFLLGVLQQGLNMLNVSSVEQSVVTGAMLIAAVGLQQLSGLFSRRRRVSRQDSSSAVETTTSARD

SEQ ID NO: 597 - DNA, 1014 bp, Alicyclobacillus acidocaldarius
gtgagaggtgtggccgagaacagaatttggtcactagctattgcgggtctgttaatcctcgagattgggttcttcggtgtgttgagcccggacttcgtaagtccgcaaaatttgctggcctcaacagagaactttcttccggttggtttcatggctctcagtatgacgctggtcatcattacaggcggcatcgacctgtccgttggttccatgatgagtctttgtggtgtcgttatgggactgctgtggcagcacggagtgaatatttggttggctgcgcttttatctatccttcttggcgcactcctaggattcatcaacggccaactcattgttcggacgggcattcaaccgctcattgccacgctggcaacgctattcatttacgggtctttagccatggtgcttgtaggtcaaggtgagggttctatttatggatttccacaatcctacctgagtctggggaccggcacggttttgaaatggatccccatccagctcattttctacggagtcgttgcttgtctattcgggttcctgctgaaatacacgagctacggcaggcaggtttacttcgttggaaacaatgagggagcagcgctgtactccggtctccaagtaaaccgcgtcaagacgattacgtatgtgctgtctggatgcatgtctggcgtagccgcggtgttcatgggtgcatacttcgcatcagttcggggcgacatgggtaccaattacgaactttcggtgatcacgtcgtgcctcgtgggcggagtaaatgtatttggaggatcaggtaccattttaggggcgttccttggaacgtttctccttggagttctgcaacaagggctcaacatgctcaatgtctcatccgtagaacaatccgtcgtaacgggcgcgatgctgattgcggctgtgggtctgcaacaactgagtggtctattctcgcgcaggcgtcgtgtctcacgtcaggacagctcgtcggcggttgagacaacaaccagtgcgcgagattag

SEQ ID NO: 598 - protein, 284 aa, Fulvimarina pelagi HTCC2506
SDRFLTTANLLNQARLMTEVGLIAIPMTFVIVTGGIDLSVGSIMGLCAILVGVFWQNAGLPLPAAVGLSLVAGTAAGLANGIIITRFRVPPLIATLATLALYRGLAEGISQARSVRGYPEWFAQLGQGQILGIPTQLWLFALVAIAGIFILRFTTFGRTTYAIGNNEAAAEFSGLPVERTKLLIYTASGFISALAAIVFVSRVSTTRSDMGNGIELEVITAVVLGGTSIFGGRGMVIGTLIGLCLMQILQNGLSLAGVRGDGTTVVIGAILIVAVLISNILGRF

SEQ ID NO: 599 - protein, 278 aa, Bacillus anthracis str. A0442
DFLNISNLLFSTNDFLFIAIAAIPMTFVIVTGGIDVSVGSIMGLTSILIGVLWMNGISILFAVIISLIISCLAGALNGFIIKMTDVEPLVVTLGTMFLYGGIALVISGGAGGSGYEGISGLPDAFVQLASGSFIGIPNLLWLLIVLTVLCAVLFHRTIYGRHVKLTGANENAAKYTGIMTKKVVIIAYMLSGLGGGLGGTFLTAYFGSARADMGSETILPIITAVVLGGTLITGGKGSIIGTVLASIFIGLMQYGLQMTGLTNEQSNVVIGIILILSV

SEQ ID NO: 600 - protein, 278 aa, Bacillus thuringiensis serovar konkukian str. 97-27
DFLNISNLLFSTNDFLFIAIAAIPMTFVIVTGGIDVSVGSIMGLTSILIGVLWMNGISILFAVIISLIISCLAGALNGLIIKMTDVEPLVVTLGTMFLYGGIALVISGGAGASGYEGISGLPDAFVQLASGSFIGIPNLLWLLIVLTVLCAVLFHRTIYGRHVKLTGANENAAKYTGIKTKKVVIIAYMLSGLGGGLGGTFLTAYFGSARADMGSETILPIITAVVLGGTLITGGKGSIIGTVLASIFIGLMQYGLQMTGLTNEQSNVVIGIILILSV

SEQ ID NO: 601 - protein, 278 aa, Bacillus cereus AH820
DFLNISNLLFSTNDFLFIAIAAIPMTFVIVTGGIDVSVGSIMGLTSILIGVLWMNGISILFAVIISLIISCLAGALNGFIIKMTDVEPLVVTLGTMFLYGGIALVISGGAGASGYEGISGLPDAFVQLASGSFIGIPNLLWLLIVLTVLCAVLFHRTIYGRHVKLTGANENAAKYTGIKTKKVVIIAYMLSGLGGGLGGTFLTAYFGSARADMGSETILPIITAVVLGGTLITGGKGSIIGTVLASIFIGLMQYGLQMTGLTNEQSNVVIGIILILSV

SEQ ID NO: 602 - protein, 278 aa, Bacillus anthracis str. Sterne
DFLNISNLLFSTNDFLFIAIAAIPMTFVIVTGGIDVSVGSIMGLTSILIGVLWMNGISILFAVIISLIISCLAGALNGFIIKMTDVEPLVVTLGTMFLYGGIALVISGGAGASGYEGISGLPDAFVQLASGSFIGIPNLLWLLIVLTVLCAVLFHRTIYGRHVKLTGANENAAKYTGIMTKKVVIIAYMLSGLGGGLGGTFLTAYFGSARADMGSETILPIITAVVLGGTLITGGKGSIIGTVLASIFIGLMQYGLQMTGLTNEQSNVVIGIILILSV

SEQ ID NO: 603 - protein, 337 aa, Artificial
  Substituion in SEQ ID NO 596
MRGVAENRIWSLAIAGLLILEIGFFGVLSPDFVSPQNLLASTENFLPVGFMALSMTLVIITGGIDLSVGSMMSLCGVVMGLLWQHGVNIWLAALLSILLGALLGFINGQLIVRTGIQPLIATLATLFIYGSLAMVLVGQGEGSIYGFPQSYLSLGTGTVLKWIPIQLIFYGVVACLFGFLLKYTSYGRQVYFVGNNEGAALYSGLQVNRVKTLTYVLSGCMSGVAAVFMGAYFASVRGDMGTNYELSVITSCLVGGVNVFGGSGTILGAFLGTFLLGVLQQGLNMLNVSSVEQSVVTGAMLIAAVGLQQLSGLFSRRRRVSRQDSSSAVETTTSARD

SEQ ID NO: 604 - protein, 337 aa, Artificial
  Substituion in SEQ ID NO 596
MRGVAENRIWSLAIAGLLILEIGFFGVLSPDFVSPQNLLASTENFLPVGFMALSMTLVIITGGIDLSVGSMMSLCGVVMGLLWQHGVNIWLAALLSILLGALLGFINGQLIVRTGIQPLIATLATLFIYGSLAMVLVGQGEGSIYGFPQSYLSLGTGTVLKWIPIQLIFYGVVACIFGFLLKYTSYGRQVYFVGNNEGAALYSGLQVNRVKTITYVLSGCMSGVAAVFMGAYFASVRGDMGTNYELSVITSCLVGGVNVFGGSGTILGAFLGTFLLGVLQQGLNMLNVSSVEQSVVTGAMLIAAVGLQQLSGLFSRRRRVSRQDSSSAVETTTSARD

SEQ ID NO: 605 - protein, 337 aa, Artificial
  Substituion in SEQ ID NO 596
MRGVAENRIWSLAIAGLLILEIGFFGVLSPDFVSPQNLLASTENFLPVGFMALSMTLVIITGGIDLSVGSMMSLCGVVMGLLWQHGVNIWLAALLSILLGALLGFINGQLIVRTGIQPLIATLATLFIYGSLAMVLVGQGEGSIYGFPQSYLSLGTGTVLKWIPIQLIFYGVVACLFGFLLKYTSYGRQVYFVGNNEGAALYSGLQVNRVKTITYVLSGCMSGVAAVFMGAYFASVRGDMGTNYELSVITSCLVGGVNVFGGSGTIIGAFLGTFLLGVLQQGLNMLNVSSVEQSVVTGAMLIAAVGLQQLSGLFSRRRRVSRQDSSSAVETTTSARD

SEQ ID NO: 606 - protein, 337 aa, Artificial
  Substituion in SEQ ID NO 596
MRGVAENRIWSLAIAGLLIIEIGFFGVLSPDFVSPQNLLASTENFLPVGFMALSMTLVIITGGIDLSVGSMMSLCGVVMGLLWQHGVNIWLAALLSILLGALLGFINGQLIVRTGIQPLIATLATLFIYGSLAMVLVGQGEGSIYGFPQSYLSLGTGTVLKWIPIQLIFYGVVACLFGFLLKYTSYGRQVYFVGNNEGAALYSGLQVNRVKTITYVLSGCMSGVAAVFMGAYFASVRGDMGTNYELSVITSCLVGGVNVFGGSGTILGAFLGTFLLGVLQQGLNMLNVSSVEQSVVTGAMLIAAVGLQQLSGLFSRRRRVSRQDSSSAVETTTSARD

SEQ ID NO: 607 - protein, 337 aa, Artificial
  Substituion in SEQ ID NO 596
MRGVAENRIWSLAIAGLLILEIGFFGVLSPDFVSPQNLLASTENFLPVGFMALSMTLVIITGGIDLSVGSMMSLCGVVMGLLWQHGVNIWLAALLSILLGALLGFINGQLIVKTGIQPLIATLATLFIYGSLAMVLVGQGEGSIYGFPQSYLSLGTGTVLKWIPIQLIFYGVVACLFGFLLKYTSYGRQVYFVGNNEGAALYSGLQVNRVKTITYVLSGCMSGVAAVFMGAYFASVRGDMGTNYELSVITSCLVGGVNVFGGSGTILGAFLGTFLLGVLQQGLNMLNVSSVEQSVVTGAMLIAAVGLQQLSGLFSRRRRVSRQDSSSAVETTTSARD

SEQ ID NO: 608 - DNA, 1014 bp, Artificial
  Substituion in SEQ ID NO 597
gtgagaggtgtggccgagaacagaatttggtcactagctattgcgggtctgttaatcctcgagattgggttcttcggtgtgttgagcccggacttcgtaagtccgcaaaatttgctggcctcaacagagaactttcttccggttggtttcatggctctcagtatgacgctggtcatcattacaggcggcatcgacctgtccgttggttccatgatgagtctttgtggtgtcgttatgggactgctgtggcagcacggagtgaatatttggttggctgcgcttttatctatccttcttggcgcactcctaggattcatcaacggccaactcattgttcggacgggcattcaaccgctcattgccacgctggcaacgctattcatttacgggtctttagccatggtgcttgtaggtcaaggtgagggttctatttatggatttccacaatcctacctgagtctggggaccggcacggttttgaaatggatccccatccagctcattttctacggagtcgttgcttgtctattcgggttcctgctgaaatacacgagctacggcaggcaggtttacttcgttggaaacaatgagggagcagcgctgtactccggtctccaagtaaaccgcgtcaagacgttaacgtatgtgctgtctggatgcatgtctggcgtagccgcggtgttcatgggtgcatacttcgcatcagttcggggcgacatgggtaccaattacgaactttcggtgatcacgtcgtgcctcgtgggcggagtaaatgtatttggaggatcaggtaccattttaggggcgttccttggaacgtttctccttggagttctgcaacaagggctcaacatgctcaatgtctcatccgtagaacaatccgtcgtaacgggcgcgatgctgattgcggctgtgggtctgcaacaactgagtggtctattctcgcgcaggcgtcgtgtctcacgtcaggacagctcgtcggcggttgagacaacaaccagtgcgcgagattag

SEQ ID NO: 609 - DNA, 1014 bp, Artificial
  Substituion in SEQ ID NO 597
gtgagaggtgtggccgagaacagaatttggtcactagctattgcgggtctgttaatcctcgagattgggttcttcggtgtgttgagcccggacttcgtaagtccgcaaaatttgctggcctcaacagagaactttcttccggttggtttcatggctctcagtatgacgctggtcatcattacaggcggcatcgacctgtccgttggttccatgatgagtctttgtggtgtcgttatgggactgctgtggcagcacggagtgaatatttggttggctgcgcttttatctatccttcttggcgcactcctaggattcatcaacggccaactcattgttcggacgggcattcaaccgctcattgccacgctggcaacgctattcatttacgggtctttagccatggtgcttgtaggtcaaggtgagggttctatttatggatttccacaatcctacctgagtctggggaccggcacggttttgaaatggatccccatccagctcattttctacggagtcgttgcttgtattttcgggttcctgctgaaatacacgagctacggcaggcaggtttacttcgttggaaacaatgagggagcagcgctgtactccggtctccaagtaaaccgcgtcaagacgattacgtatgtgctgtctggatgcatgtctggcgtagccgcggtgttcatgggtgcatacttcgcatcagttcggggcgacatgggtaccaattacgaactttcggtgatcacgtcgtgcctcgtgggcggagtaaatgtatttggaggatcaggtaccattttaggggcgttccttggaacgtttctccttggagttctgcaacaagggctcaacatgctcaatgtctcatccgtagaacaatccgtcgtaacgggcgcgatgctgattgcggctgtgggtctgcaacaactgagtggtctattctcgcgcaggcgtcgtgtctcacgtcaggacagctcgtcggcggttgagacaacaaccagtgcgcgagattag

SEQ ID NO: 610 - DNA, 1014 bp, Artificial
  Substituion in SEQ ID NO 597
gtgagaggtgtggccgagaacagaatttggtcactagctattgcgggtctgttaatcctcgagattgggttcttcggtgtgttgagcccggacttcgtaagtccgcaaaatttgctggcctcaacagagaactttcttccggttggtttcatggctctcagtatgacgctggtcatcattacaggcggcatcgacctgtccgttggttccatgatgagtctttgtggtgtcgttatgggactgctgtggcagcacggagtgaatatttggttggctgcgcttttatctatccttcttggcgcactcctaggattcatcaacggccaactcattgttcggacgggcattcaaccgctcattgccacgctggcaacgctattcatttacgggtctttagccatggtgcttgtaggtcaaggtgagggttctatttatggatttccacaatcctacctgagtctggggaccggcacggttttgaaatggatccccatccagctcattttctacggagtcgttgcttgtctattcgggttcctgctgaaatacacgagctacggcaggcaggtttacttcgttggaaacaatgagggagcagcgctgtactccggtctccaagtaaaccgcgtcaagacgattacgtatgtgctgtctggatgcatgtctggcgtagccgcggtgttcatgggtgcatacttcgcatcagttcggggcgacatgggtaccaattacgaactttcggtgatcacgtcgtgcctcgtgggcggagtaaatgtatttggaggatcaggtaccattattggggcgttccttggaacgtttctccttggagttctgcaacaagggctcaacatgctcaatgtctcatccgtagaacaatccgtcgtaacgggcgcgatgctgattgcggctgtgggtctgcaacaactgagtggtctattctcgcgcaggcgtcgtgtctcacgtcaggacagctcgtcggcggttgagacaacaaccagtgcgcgagattag

SEQ ID NO: 611 - DNA, 1014 bp, Artificial
  Substituion in SEQ ID NO 597
gtgagaggtgtggccgagaacagaatttggtcactagctattgcgggtctgttaatcattgagattgggttcttcggtgtgttgagcccggacttcgtaagtccgcaaaatttgctggcctcaacagagaactttcttccggttggtttcatggctctcagtatgacgctggtcatcattacaggcggcatcgacctgtccgttggttccatgatgagtctttgtggtgtcgttatgggactgctgtggcagcacggagtgaatatttggttggctgcgcttttatctatccttcttggcgcactcctaggattcatcaacggccaactcattgttcggacgggcattcaaccgctcattgccacgctggcaacgctattcatttacgggtctttagccatggtgcttgtaggtcaaggtgagggttctatttatggatttccacaatcctacctgagtctggggaccggcacggttttgaaatggatccccatccagctcattttctacggagtcgttgcttgtctattcgggttcctgctgaaatacacgagctacggcaggcaggtttacttcgttggaaacaatgagggagcagcgctgtactccggtctccaagtaaaccgcgtcaagacgattacgtatgtgctgtctggatgcatgtctggcgtagccgcggtgttcatgggtgcatacttcgcatcagttcggggcgacatgggtaccaattacgaactttcggtgatcacgtcgtgcctcgtgggcggagtaaatgtatttggaggatcaggtaccattttaggggcgttccttggaacgtttctccttggagttctgcaacaagggctcaacatgctcaatgtctcatccgtagaacaatccgtcgtaacgggcgcgatgctgattgcggctgtgggtctgcaacaactgagtggtctattctcgcgcaggcgtcgtgtctcacgtcaggacagctcgtcggcggttgagacaacaaccagtgcgcgagattag

SEQ ID NO: 612 - DNA, 1014 bp, Artificial
  Substituion in SEQ ID NO 597
gtgagaggtgtggccgagaacagaatttggtcactagctattgcgggtctgttaatcctcgagattgggttcttcggtgtgttgagcccggacttcgtaagtccgcaaaatttgctggcctcaacagagaactttcttccggttggtttcatggctctcagtatgacgctggtcatcattacaggcggcatcgacctgtccgttggttccatgatgagtctttgtggtgtcgttatgggactgctgtggcagcacggagtgaatatttggttggctgcgcttttatctatccttcttggcgcactcctaggattcatcaacggccaactcattgttaaaacgggcattcaaccgctcattgccacgctggcaacgctattcatttacgggtctttagccatggtgcttgtaggtcaaggtgagggttctatttatggatttccacaatcctacctgagtctggggaccggcacggttttgaaatggatccccatccagctcattttctacggagtcgttgcttgtctattcgggttcctgctgaaatacacgagctacggcaggcaggtttacttcgttggaaacaatgagggagcagcgctgtactccggtctccaagtaaaccgcgtcaagacgattacgtatgtgctgtctggatgcatgtctggcgtagccgcggtgttcatgggtgcatacttcgcatcagttcggggcgacatgggtaccaattacgaactttcggtgatcacgtcgtgcctcgtgggcggagtaaatgtatttggaggatcaggtaccattttaggggcgttccttggaacgtttctccttggagttctgcaacaagggctcaacatgctcaatgtctcatccgtagaacaatccgtcgtaacgggcgcgatgctgattgcggctgtgggtctgcaacaactgagtggtctattctcgcgcaggcgtcgtgtctcacgtcaggacagctcgtcggcggttgagacaacaaccagtgcgcgagattag

SEQ ID NO: 613 - protein, 314 aa, Alicyclobacillus acidocaldarius
MSGLLKRREFSLVVFILIFLLVMLFVTPRFLQLGNLINILLNISTVGILAMGQCLVIITKGIDLSVGANMGLVTLVVGTLLLNGVPTWLSIAIGVATGLVCGGLNAVLISLLRLPPIIVTLGTLSLFSGLMYMVTNGQWIQNLPSSFLAIGNSKVVGIPGPVIVLVIVLIVLSVFMEQTVLGRYIYAVGNNPNAARLAGLSTNRTIIVPYVLMGLLAGIAGVLYLSYNGFSTPTTGADLNLESIAAAVIGGTNVFGGRGTALGSVLGAVLLGVITEALVFFHLPAVWNDAVEGLIILIAVIADSGLRRSQRVAG

SEQ ID NO: 614 - DNA, 945 bp, Alicyclobacillus acidocaldarius
atgagtggattactgaaaaggcgcgagttttcactcgttgtgttcatcctgatttttctactcgttatgttgttcgttactccgcgttttcttcaactggggaatcttatcaatatactacttaacatatcgacggttggaattttggcaatgggtcagtgcttggtcatcatcacgaaggggattgatctgtcggttggggcaaatatggggcttgtgacgctcgtggttggcaccctgttactgaacggtgtgccgacctggttgagcatcgcgatcggtgtggctacggggcttgtgtgtggcgggctgaatgcagtgttgattagccttctaaggctaccacctatcatcgtgacactaggaactctcagtttgttctcgggtttgatgtacatggtcaccaatgggcaatggattcaaaatctaccttcatcatttcttgccataggaaattcgaaagttgtaggcatacctggtccagtgattgtgcttgtgatcgtcttgattgtgctgtccgtcttcatggaacaaacagtccttggtcggtacatctacgccgttggcaacaacccaaacgctgctcgtctggcaggcctatcgacgaatcgtaccatcatcgtcccttacgtcctgatgggtttgctggccggcattgcaggggttttgtacctgtcatataacggcttctctaccccaactaccggcgccgatttaaatttggagtctatcgcggcggccgtgatcggtggaaccaatgtctttggcggacgcggtaccgcattggggtcggttctaggtgcggttctgcttggggtgattaccgaggcactggtgttctttcatctcccagcagtctggaacgacgcagtcgaaggtctgatcatcctgattgcggtcatcgcggatagcggattgcggcgttcgcaaagggtagcggggtga

SEQ ID NO: 615 - protein, 308 aa, Bacillus cereus ATCC 14579
MKHMLKMHETSIILLLLIYIAIVGMINPSFIQFNSLSLLMKSSVILVVLAIGQSFVLFTKNIDVSVGSSMGLSAAVCGMMLTNGYSAFLSIFVAIILGAIIGFVNGIGVAKFRVPAIIMTLGMLGIIRGTMLIFTGGKWIEDIPNDFKQLSSIIILGLPITVWFVLIILLLLYFFLRKVPLGRYFYAVGDNEDGARLIGIPVNKVKIYAFMISGISAALAGCIFVMNIGFVPNQTGTGLELQVIAAAVLGGIHLKGGTGSLFGAALGALFLETISSSLVFLKIPAFWNNAISGFLLLLIIILDSVMKK

SEQ ID NO: 616 - protein, 282 aa, Delftia acidovorans SPH-1
PHFMTWGNWADILRQTSINGILAIGMTCVVLTAGIDLSVGAILALAGMVGAWLAADGQGLAVSVGAGLGVGMLLGGVNGLLVAWFAVPPFVATLGMLSAARGLTYIYNDGMPVSELPDGFLAIGAGQLGPVPMPIVIFAVAVAVFAFVLRYTVYGRYIYAVGGNLRSAKTSGINTRAIVLLVYVVSGLLAGLAGILLASRTTAALPQAGVSYELDAIAAVVIGGTSLSGGTGSLGGTVVGALLIGVINNGLNLLGVSSYYQQLIKGVIIVGAVLLDSSRRRA

SEQ ID NO: 617 - protein, 308 aa, Bacillus cereus G9241
MKRMLKMHETSIILLLLIYIAIVGMINPSFIQFNSLSLLIKSSVILVVLAIGQSFVLFTKNIDVSVGSSMGLSAAVCGMMLTNGYSAFLSIFAAIILGAIIGFVNGIGVAKFRVPAIIMTLGMLGIIRGAMLIFTGGKWIEDIPSHFKQLSSIVILGLPITVWFVLIILLLLYFFLRKVPFGRYFYAVGDNEDGARLIGIPVNQVKIYAFIISGISAALAGCIFVMNIGFVPNQTGTGLELQVIAAAVLGGIHLKGGTGSIFGAALGALFLETISSSLVFLKIPAFWNNAISGFLLLLIIILDSVMKK

SEQ ID NO: 618 - protein, 309 aa, Enterobacter sp. 638
MKTLLKNRELSAFLAILALFGVLVALNPAYLSFQTLGMIFASSQILILLALGAALVMLTRNIDVSVGSTVGLCAIAVGVALNNGYSLPVSMLFALAIGALAGAFNGLLVVGLRIPAIVATLGTLGLYRGAMLLWTGGKWIEGLPSSLKSLSEPVALGVSPLGMAVLFLVLIGAWTLSRTVSGRDFYAVGDNLAAARQLGVAVNRTRMLAFTINGMLAACAGIVFASQIGFVPNQTGSGLEMKAIAACVLGGISLLGGTGTLIGAFLGAFFLTQIDTVLVLFRLPAWWNDFIAGLVLLGVLVLDGRLRQA

SEQ ID NO: 619 - protein, 309 aa, Klebsiella pneumoniae subsp. pneumoniae MGH 78578
MKTLLKNRELSAFFAIVALFVVLVALNPAYFILQTLAMIFASSQILCLLALGATLVMLTRNIDVSVGSTVGLCAIAVGVALNYGYGLATAIAFALAIGALAGAFNGLLVVGLRIPAIVATLGTLGLYRGVMLLWTGGKWIEGLPDSLKSLSEPAFIGVSPLGWLVLALLLAGGWLLSRTAFGRDFYAVGDNLAAARQLGVAVNRTRMLAFTLNGMLAACAGIVFAAQIGFVPNQTGSGLEMKAIAACVLGGISLLGGTGTLLGAFLGAFFLTQIDTVLVLFRLPAWWNDFIAGLVLLGVLVLDGRLRQA

SEQ ID NO: 620 - protein, 314 aa, Artificial
  Substituion in SEQ ID NO 613
MSGLLKRREFSLVVFILIFLLVMLFVTPRFLQIGNLINILLNISTVGILAMGQCLVIITKGIDLSVGANMGLVTLVVGTLLLNGVPTWLSIAIGVATGLVCGGLNAVLISLLRLPPIIVTLGTLSLFSGLMYMVTNGQWIQNLPSSFLAIGNSKVVGIPGPVIVLVIVLIVLSVFMEQTVLGRYIYAVGNNPNAARLAGLSTNRTIIVPYVLMGLLAGIAGVLYLSYNGFSTPTTGADLNLESIAAAVIGGTNVFGGRGTALGSVLGAVLLGVITEALVFFHLPAVWNDAVEGLIILIAVIADSGLRRSQRVAG

SEQ ID NO: 621 - protein, 314 aa, Artificial
  Substituion in SEQ ID NO 613
MSGLLKRREFSLVVFILIFLLVMLFVTPRFLQLGNLINILLNISTVGILAMGQCLVIITKGIDLSVGANMGLVTLVVGTLLLNGVPTWLSIAIGVATGLVCGGLNAVLISLLRLPPIIVTLGTLSLFSGLMYMVTNGQWIQNLPSSFLAIGNSKVVGIPGPVIVLVIVLIVLSVFMEQTVLGRYLYAVGNNPNAARLAGLSTNRTIIVPYVLMGLLAGIAGVLYLSYNGFSTPTTGADLNLESIAAAVIGGTNVFGGRGTALGSVLGAVLLGVITEALVFFHLPAVWNDAVEGLIILIAVIADSGLRRSQRVAG

SEQ ID NO: 622 - protein, 314 aa, Artificial
  Substituion in SEQ ID NO 613
MSGLLKRREFSLVVFILIFLLVMLFVTPRFLQLGNLINILLNISTVGILAMGQCLVIITKGIDLSVGANMGLVTLVVGTLLLNGVPTWLSIAIGVATGLVCGGLNAVLISLLRLPPIIVTLGTLSLFSGLMYMVTNGQWIQNLPSSFLAIGNSKVIGIPGPVIVLVIVLIVLSVFMEQTVLGRYIYAVGNNPNAARLAGLSTNRTIIVPYVLMGLLAGIAGVLYLSYNGFSTPTTGADLNLESIAAAVIGGTNVFGGRGTALGSVLGAVLLGVITEALVFFHLPAVWNDAVEGLIILIAVIADSGLRRSQRVAG

SEQ ID NO: 623 - protein, 314 aa, Artificial
  Substituion in SEQ ID NO 613
MSGLLKRREFSLVVFILIFLLVMLFVTPRFLQLGNLINILLNISTVGILAMGQCLVIITKGIDISVGANMGLVTLVVGTLLLNGVPTWLSIAIGVATGLVCGGLNAVLISLLRLPPIIVTLGTLSLFSGLMYMVTNGQWIQNLPSSFLAIGNSKVVGIPGPVIVLVIVLIVLSVFMEQTVLGRYIYAVGNNPNAARLAGLSTNRTIIVPYVLMGLLAGIAGVLYLSYNGFSTPTTGADLNLESIAAAVIGGTNVFGGRGTALGSVLGAVLLGVITEALVFFHLPAVWNDAVEGLIILIAVIADSGLRRSQRVAG

SEQ ID NO: 624 - protein, 314 aa, Artificial
  Substituion in SEQ ID NO 613
MSGLLKRREFSLVVFILIFLLVMLFVTPRFLQLGNLINILLNISTVGILAMGQCLVIITKGIDLSVGANMGLVTLVVGTLLLNGVPTWLSIAIGVATGLVCGGLNAVLISLLRLPPIIVTLGTLSLFSGLMYMVTNGQWIQNLPSSFLAIGNSKVVGIPGPVIVLVIVLIVLSVFMEQTVLGRYIYAVGNNPNAARLAGLSTQRTIIVPYVLMGLLAGIAGVLYLSYNGFSTPTTGADLNLESIAAAVIGGTNVFGGRGTALGSVLGAVLLGVITEALVFFHLPAVWNDAVEGLIILIAVIADSGLRRSQRVAG

SEQ ID NO: 625 - DNA, 945 bp, Artificial
  Substituion in SEQ ID NO 614
atgagtggattactgaaaaggcgcgagttttcactcgttgtgttcatcctgatttttctactcgttatgttgttcgttactccgcgttttcttcaaattgggaatcttatcaatatactacttaacatatcgacggttggaattttggcaatgggtcagtgcttggtcatcatcacgaaggggattgatctgtcggttggggcaaatatggggcttgtgacgctcgtggttggcaccctgttactgaacggtgtgccgacctggttgagcatcgcgatcggtgtggctacggggcttgtgtgtggcgggctgaatgcagtgttgattagccttctaaggctaccacctatcatcgtgacactaggaactctcagtttgttctcgggtttgatgtacatggtcaccaatgggcaatggattcaaaatctaccttcatcatttcttgccataggaaattcgaaagttgtaggcatacctggtccagtgattgtgcttgtgatcgtcttgattgtgctgtccgtcttcatggaacaaacagtccttggtcggtacatctacgccgttggcaacaacccaaacgctgctcgtctggcaggcctatcgacgaatcgtaccatcatcgtcccttacgtcctgatgggtttgctggccggcattgcaggggttttgtacctgtcatataacggcttctctaccccaactaccggcgccgatttaaatttggagtctatcgcggcggccgtgatcggtggaaccaatgtctttggcggacgcggtaccgcattggggtcggttctaggtgcggttctgcttggggtgattaccgaggcactggtgttctttcatctcccagcagtctggaacgacgcagtcgaaggtctgatcatcctgattgcggtcatcgcggatagcggattgcggcgttcgcaaagggtagcggggtga

SEQ ID NO: 626 - DNA, 945 bp, Artificial
  Substituion in SEQ ID NO 614
atgagtggattactgaaaaggcgcgagttttcactcgttgtgttcatcctgatttttctactcgttatgttgttcgttactccgcgttttcttcaactggggaatcttatcaatatactacttaacatatcgacggttggaattttggcaatgggtcagtgcttggtcatcatcacgaaggggattgatctgtcggttggggcaaatatggggcttgtgacgctcgtggttggcaccctgttactgaacggtgtgccgacctggttgagcatcgcgatcggtgtggctacggggcttgtgtgtggcgggctgaatgcagtgttgattagccttctaaggctaccacctatcatcgtgacactaggaactctcagtttgttctcgggtttgatgtacatggtcaccaatgggcaatggattcaaaatctaccttcatcatttcttgccataggaaattcgaaagttgtaggcatacctggtccagtgattgtgcttgtgatcgtcttgattgtgctgtccgtcttcatggaacaaacagtccttggtcggtacttatacgccgttggcaacaacccaaacgctgctcgtctggcaggcctatcgacgaatcgtaccatcatcgtcccttacgtcctgatgggtttgctggccggcattgcaggggttttgtacctgtcatataacggcttctctaccccaactaccggcgccgatttaaatttggagtctatcgcggcggccgtgatcggtggaaccaatgtctttggcggacgcggtaccgcattggggtcggttctaggtgcggttctgcttggggtgattaccgaggcactggtgttctttcatctcccagcagtctggaacgacgcagtcgaaggtctgatcatcctgattgcggtcatcgcggatagcggattgcggcgttcgcaaagggtagcggggtga

SEQ ID NO: 627 - DNA, 945 bp, Artificial
  Substituion in SEQ ID NO 614
atgagtggattactgaaaaggcgcgagttttcactcgttgtgttcatcctgatttttctactcgttatgttgttcgttactccgcgttttcttcaactggggaatcttatcaatatactacttaacatatcgacggttggaattttggcaatgggtcagtgcttggtcatcatcacgaaggggattgatctgtcggttggggcaaatatggggcttgtgacgctcgtggttggcaccctgttactgaacggtgtgccgacctggttgagcatcgcgatcggtgtggctacggggcttgtgtgtggcgggctgaatgcagtgttgattagccttctaaggctaccacctatcatcgtgacactaggaactctcagtttgttctcgggtttgatgtacatggtcaccaatgggcaatggattcaaaatctaccttcatcatttcttgccataggaaattcgaaagttattggcatacctggtccagtgattgtgcttgtgatcgtcttgattgtgctgtccgtcttcatggaacaaacagtccttggtcggtacatctacgccgttggcaacaacccaaacgctgctcgtctggcaggcctatcgacgaatcgtaccatcatcgtcccttacgtcctgatgggtttgctggccggcattgcaggggttttgtacctgtcatataacggcttctctaccccaactaccggcgccgatttaaatttggagtctatcgcggcggccgtgatcggtggaaccaatgtctttggcggacgcggtaccgcattggggtcggttctaggtgcggttctgcttggggtgattaccgaggcactggtgttctttcatctcccagcagtctggaacgacgcagtcgaaggtctgatcatcctgattgcggtcatcgcggatagcggattgcggcgttcgcaaagggtagcggggtga

SEQ ID NO: 628 - DNA, 945 bp, Artificial
  Substituion in SEQ ID NO 614
atgagtggattactgaaaaggcgcgagttttcactcgttgtgttcatcctgatttttctactcgttatgttgttcgttactccgcgttttcttcaactggggaatcttatcaatatactacttaacatatcgacggttggaattttggcaatgggtcagtgcttggtcatcatcacgaaggggattgatatttcggttggggcaaatatggggcttgtgacgctcgtggttggcaccctgttactgaacggtgtgccgacctggttgagcatcgcgatcggtgtggctacggggcttgtgtgtggcgggctgaatgcagtgttgattagccttctaaggctaccacctatcatcgtgacactaggaactctcagtttgttctcgggtttgatgtacatggtcaccaatgggcaatggattcaaaatctaccttcatcatttcttgccataggaaattcgaaagttgtaggcatacctggtccagtgattgtgcttgtgatcgtcttgattgtgctgtccgtcttcatggaacaaacagtccttggtcggtacatctacgccgttggcaacaacccaaacgctgctcgtctggcaggcctatcgacgaatcgtaccatcatcgtcccttacgtcctgatgggtttgctggccggcattgcaggggttttgtacctgtcatataacggcttctctaccccaactaccggcgccgatttaaatttggagtctatcgcggcggccgtgatcggtggaaccaatgtctttggcggacgcggtaccgcattggggtcggttctaggtgcggttctgcttggggtgattaccgaggcactggtgttctttcatctcccagcagtctggaacgacgcagtcgaaggtctgatcatcctgattgcggtcatcgcggatagcggattgcggcgttcgcaaagggtagcggggtga

SEQ ID NO: 629 - DNA, 945 bp, Artificial
  Substituion in SEQ ID NO 614
atgagtggattactgaaaaggcgcgagttttcactcgttgtgttcatcctgatttttctactcgttatgttgttcgttactccgcgttttcttcaactggggaatcttatcaatatactacttaacatatcgacggttggaattttggcaatgggtcagtgcttggtcatcatcacgaaggggattgatctgtcggttggggcaaatatggggcttgtgacgctcgtggttggcaccctgttactgaacggtgtgccgacctggttgagcatcgcgatcggtgtggctacggggcttgtgtgtggcgggctgaatgcagtgttgattagccttctaaggctaccacctatcatcgtgacactaggaactctcagtttgttctcgggtttgatgtacatggtcaccaatgggcaatggattcaaaatctaccttcatcatttcttgccataggaaattcgaaagttgtaggcatacctggtccagtgattgtgcttgtgatcgtcttgattgtgctgtccgtcttcatggaacaaacagtccttggtcggtacatctacgccgttggcaacaacccaaacgctgctcgtctggcaggcctatcgacgcaacgtaccatcatcgtcccttacgtcctgatgggtttgctggccggcattgcaggggttttgtacctgtcatataacggcttctctaccccaactaccggcgccgatttaaatttggagtctatcgcggcggccgtgatcggtggaaccaatgtctttggcggacgcggtaccgcattggggtcggttctaggtgcggttctgcttggggtgattaccgaggcactggtgttctttcatctcccagcagtctggaacgacgcagtcgaaggtctgatcatcctgattgcggtcatcgcggatagcggattgcggcgttcgcaaagggtagcggggtga

SEQ ID NO: 630 - protein, 446 aa, Alicyclobacillus acidocaldarius
MRAKKIRYATMAASVAMAGIMASGCGTSTASRTGTAPTQQESASTHQPVTITVASWNDAADSLRAEIPGFEKKYPWIKVNVEYVDGTYQKVIPELVAGDAPDIIQVQQRDFQTFLHKFPGDFVDLTPYMSSIKNHIAPVALDVTVQNGHIYAAPWDLGPAALYYRKDLFREAGINPTSIKTWSDYLAAGKKLVAHFHGKVKMLAENTSEPSQGIQTTLMILVNELGGSYVNQNGDIDFLNPQLEKAMSVIQQWGKAGIVADAPTWNDGIAAFANGQVATILSAVWYAGTMMNSAPKQSGLWGIVPLPAFTPGGNNEADTGGSVLAITKDSKNVQAAWDFINYCLYTVPGENVQLKYGLFPSWESYYTAKGTDFDQNFPYFGMPIYKFFASVSKHIPTTNYGGYFEDYSQPLSQAYISVFKGANIEQALQTAETNAARISGQPISNG

SEQ ID NO: 631 - DNA, 1341 bp, Alicyclobacillus acidocaldarius
atgcgcgcgaagaagattagatatgcgacaatggctgcatctgtagcgatggcgggaatcatggcttccggctgcgggacaagtaccgcatcaaggaccggcactgcgccgacccaacaggaaagcgcttcgactcaccagcccgtgacgattacggtggcctcctggaacgatgctgcagactccttgagggcagagatcccaggattcgaaaaaaaatacccatggattaaagtgaacgtggaatatgtggatgggacgtatcagaaggtgatcccagaacttgttgccggagacgcacctgatatcatccaggttcagcaacgagattttcaaactttcctccataagtttccgggagattttgtcgatttgactccgtacatgagctcaatcaaaaatcatatagctcctgtcgcgctggacgtaactgtgcaaaacggtcatatctacgctgctccgtgggatctggggccggctgcgttgtattaccgaaaggacctgttccgcgaagcgggaattaatccaacttcaattaagacctggtctgattaccttgctgcgggtaagaagttagtcgcacattttcatggaaaggttaagatgctagctgagaacacgtcggagccaagccaaggcattcagacgaccctcatgatcttggtcaatgagcttggcggaagttatgtgaatcagaacggagatattgatttcttaaaccctcaactcgagaaggccatgagtgtgattcagcagtggggtaaggcagggattgtggcggatgcacctacgtggaacgacggtatcgctgcgtttgccaatggacaggttgccacgattctgtcggccgtttggtatgccggcactatgatgaatagtgcgcccaagcaaagtggtttgtggggcattgttccgcttccggcattcacgcctggtgggaacaatgaagctgatacgggtggctctgttttggcaattacgaaagacagcaagaatgttcaggcggcctgggacttcattaattactgtttgtataccgtcccgggagagaatgttcagttgaaatacggtctgttcccttcgtgggagtcgtactatacggctaagggtactgactttgatcagaatttcccttacttcggaatgccgatctataagttcttcgcatccgtatcgaagcacattccgactaccaactatggtggctatttcgaggattactctcaaccgctatcacaagcttacatttcggtatttaagggcgcgaatatcgaacaagcgcttcagactgccgaaacgaatgccgcacgtatctctggtcaacccatttcaaatggataa

SEQ ID NO: 632 - protein, 431 aa, Herpetosiphon aurantiacus ATCC 23779
SLLVLTLILAACGSDSTATTTSNTGSTNPAEVKGEITVWAWNVAAKSLEATVPSFNQKYPNVKVTVQDIGRTDVYDKLTSGLQAGGAGLPDVVAIESDRMDVYTSTFPDGLADLTSRASKYEKDFDPSKWAQSKISDKIRSIPWDSGPTGLWYRVDIFEQAGVDPKSIETWADLIAAGEKILAATDGKTKLLPVDIVADDAGFRMMTSQLGVCCYFNNDGKINLTNDKSVQALTLLKEINDKGLVANINGWDGTVAATKNGDVATVPFGVWYSGTIIDQAPDLSGKWDVMLLPAFEKGGNRAANLGGSTLAIPAATKNLDAAWLFVEHALATSEGQNIMMEKFGIWPSYQPAYSADLYSKPVAFFNNQPIWKLFADEIKNIPPATYTKDYAKGQAVLASAQAKVLSQGMDPKQALQEAAAELANQTGREIA

SEQ ID NO: 633 - protein, 428 aa, Bacillus selenitireducens MLS10
GENDSANNGSASANNDDANENNNAGDGDEDISGEVTAWGWNVAAAAMEQAIEGFNELYPNVTVNIEDIGREDVYDRLTVGLAAGGSGLPDISMVETDRLDNYFAEFPQGFVNLDEYGFNEHEDKFADSKVEAVKGPDGNNLAAPWDIGPAGVFYYVPHFEEAGVDPDDIETWDDFIAAGEDILDATGAAMVPVDIANDDAIFRMMMNQLGVYYFDADGAIEIASDDAALAMSKIQEMHEKDLVANVDGWDGTVTSTVNHTVATIPFGVWYAGTITDQAPDQSGDWGVFKLPAFEEGGNRDANLGGSDLTILSSTEYPEAAYAFVEYFTTEIEPQIEGMTEYGLFPSLLATYDEPYFQENNEFFNDEPIWSLFADVVEGTLPANYTNDYARAFRYASDAQANALLSGEDVQVALQEAAERIANETGRDI

SEQ ID NO: 634 - protein, 423 aa, Rhizobium leguminosarum bv. trifolii WSM1325
MRFKLLAATAAVAVLASGSAYAQSANLTIWSWNVAASALKSTLPGFNKQFPDIKITVEDLGNSQVFDKTLAACAAGGDGLPDIVSIENFEAEIFWSRFPDCFANLKELGYTADIQAKFPDFKRTELEVGDVAYAMPWDSGPVAVFYRRDLYEKAGVDPSTISTWDDFIAAGKKISAANPGVVMAQADFNGDSEWFRMIANEQGCGYYSTDGQNITINQPACVATLQKVKEMKDAGTLTAANWEEKIQADTAGKAASQLYGGWYEGTVRSTSPDLKGKWGVYRMPSLTADGPHAANLGGSSLAISATSANKEAAWKFVNYALGTDEGQITMLKEFGLVPSLLSAEKDPFVNEPQPYWGGQKVWADILATLPKIVPSRGTAFQSDAEAIFKATQTKFFAGGYPDAKAALDDAANQIASATGLPIA

SEQ ID NO: 635 - protein, 401 aa, Rhizobium leguminosarum bv. viciae 3841
QSANLTIWSWNVAASALKSTLPGFNKQFPDIKITVEDLGNSQVFDKTLAACAAGGDGLPDIVTIENFEAEIFWSRFPDCFANLKELGYTADIQAKFPEFKRTELEVGDVAYAMPWDSGPVAVFYRRDFYEKAGVDPSTINTWDDFIAAGKKISAANPGTVMAQADFNGDSEWFRMIANEQGCGYYSADGQNITINQPACVSSLQKVKEMKDAGTLTAANWDEKIQANTAGKAASQLYGGWYEGTVRSTSPDLKGKWGVYKMPSLTADGPHAANLGGSSLAISATSANKEAAWKFVNYALGTNEGQVTMLKEFGLVPSLLSAVQDPFVNEPQPYWGGQKVWADILATLPKIVPSRGTAFQSDAEAIFKATQTKFFSGGYPDAKAALDDAANQIASATGLPIA

SEQ ID NO: 636 - protein, 409 aa, Mesorhizobium loti MAFF303099
GSAPAFAQSGEITIWSWNVAASSLKATVAGFNKLHPDIKVTVQDLGNQPTYDKSIAGCAAGGVGLPDIVTIENGEAENYWSQFPDCFVDLHTLGYTSEDQKKFPDFKRTELEVGDKAYAMPWDSGPVAAFYRRDFYEKAGVDPASIKTWDDFIAAGKKIQAANPGVSMTNADFNGDTEFFRMISNEQGCAYFAEDGQSITVSEPKCVDALTKVKEMKDAGIVSSADWGTKITNNTAGTVATQVYGGWYEGTIRTESAGENGKWGVYLMPSLTADGPRAANLGGSSLAITSASKNKEAAYEYLKYTLGTNEGQITMLKEFGLVPSLVSALNDPYVSQGLPYWGGQAVWKDILGTLPKVVPSRGTQFQSDAEIIVRAVQTKYLAGGYPDAKAALDDAAKQIAAATGLPVKS

SEQ ID NO: 637 - protein, 446 aa, Artificial
  Substituion in SEQ ID NO 630
MRAKKIRYATMAASVAMAGIMASGCGTSTASRTGTAPTQQESASTHQPVTITVASWNDAADSLRAEIPGFEKKYPWIKVNVEYVDGTYQKVIPELVAGDAPDIIQVQQRDFQTFLHKFPGDFVDLTPYMSSIKNHIAPVALDVTVQNGHIYAAPWDLGPAALYYRKDLFREAGINPTSIKTWSDYLAAGKKLVAHFHGKVKMLAENTSEPSQGIQTTLMILVNELGGSYVNQNGDIDFLNPQLEKAMSVIQQWGKAGIVADAPTWNDGIAAFANGQVATILSAVWYAGTMMNSAPKQSGLWGIVPLPAFTPGGNNEADTGGSVLAITKDSKNVQAAWDFINYCLYTVPGENVQLKYGLFPSWDSYYTAKGTDFDQNFPYFGMPIYKFFASVSKHIPTTNYGGYFEDYSQPLSQAYISVFKGANIEQALQTAETNAARISGQPISNG

SEQ ID NO: 638 - protein, 446 aa, Artificial
  Substituion in SEQ ID NO 630
MRAKKIRYATMAASVAMAGIMASGCGTSTASRTGTAPTQQESASTHQPVTITVASWNDAADSLRAEIPGFEKKYPWIKVNVEYVDGTYQKVIPELVAGDAPDIIQVQQRDFQTFLHKFPGDFVDLTPYMSSIKNHIAPVALDVTVQNGHIYAAPWDLGPAALYYRKDLFREAGINPTSIKTWSDYLAAGKKLVAHFHGKVKMLAENTSEPSQGIQTTLMILVNELGGSYVNQNGDIDFLNPQLEKAMSVIQQWGKAGIVADAPTWNDGLAAFANGQVATILSAVWYAGTMMNSAPKQSGLWGIVPLPAFTPGGNNEADTGGSVLAITKDSKNVQAAWDFINYCLYTVPGENVQLKYGLFPSWESYYTAKGTDFDQNFPYFGMPIYKFFASVSKHIPTTNYGGYFEDYSQPLSQAYISVFKGANIEQALQTAETNAARISGQPISNG

SEQ ID NO: 639 - protein, 446 aa, Artificial
  Substituion in SEQ ID NO 630
MRAKKIRYATMAASVAMAGIMASGCGTSTASRTGTAPTQQESASTHQPVTITVASWNDAADSLRAEIPGFEKKYPWIKVNVEYVDGTYQRVIPELVAGDAPDIIQVQQRDFQTFLHKFPGDFVDLTPYMSSIKNHIAPVALDVTVQNGHIYAAPWDLGPAALYYRKDLFREAGINPTSIKTWSDYLAAGKKLVAHFHGKVKMLAENTSEPSQGIQTTLMILVNELGGSYVNQNGDIDFLNPQLEKAMSVIQQWGKAGIVADAPTWNDGIAAFANGQVATILSAVWYAGTMMNSAPKQSGLWGIVPLPAFTPGGNNEADTGGSVLAITKDSKNVQAAWDFINYCLYTVPGENVQLKYGLFPSWESYYTAKGTDFDQNFPYFGMPIYKFFASVSKHIPTTNYGGYFEDYSQPLSQAYISVFKGANIEQALQTAETNAARISGQPISNG

SEQ ID NO: 640 - protein, 446 aa, Artificial
  Substituion in SEQ ID NO 630
MRAKKIRYATMAASVAMAGIMASGCGTSTASRTGTAPTQQESASTHQPVTITVASWNDAADSLRAEIPGFEKKYPWIKVNVEYVDGTYQKVIPELVAGDAPDIIQVQQRDFQTFLHKFPGDFVDLTPYMSSIKNHIAPVAIDVTVQNGHIYAAPWDLGPAALYYRKDLFREAGINPTSIKTWSDYLAAGKKLVAHFHGKVKMLAENTSEPSQGIQTTLMILVNELGGSYVNQNGDIDFLNPQLEKAMSVIQQWGKAGIVADAPTWNDGIAAFANGQVATILSAVWYAGTMMNSAPKQSGLWGIVPLPAFTPGGNNEADTGGSVLAITKDSKNVQAAWDFINYCLYTVPGENVQLKYGLFPSWESYYTAKGTDFDQNFPYFGMPIYKFFASVSKHIPTTNYGGYFEDYSQPLSQAYISVFKGANIEQALQTAETNAARISGQPISNG

SEQ ID NO: 641 - protein, 446 aa, Artificial
  Substituion in SEQ ID NO 630
MRAKKIRYATMAASVAMAGIMASGCGTSTASRTGTAPTQQESASTHQPVTITVASWNDAADSLRAEIPGFEKKYPWIKVNVEYVDGTYQKVIPELVAGDAPDIIQVQQRDFQTFLHKFPGDFVDLTPYMSSIKNHIAPVALDVTVQNGHIYAAPWDLGPAALYYRKDLFREAGINPTSIKTWSDYLAAGKKLVAHFHGKVKMLAENTSEPSQGIQTTLMILVNELGGSYVNQNGDIDFLNPQLEKAMSVIQQWGKAGIVADAPTWNDGIAAFANGQVATILSAVWYAGTMMNSAPKQSGLWGIVPLPAFTPGGNNEADTGGSVLAITKDSKNVQAAWDFINYCLYTVPGENVQLKYGLFPSWESYYTAKGTDFDQNFPYFGMPIYKFFASVSKHIPTTNYGGYFEDYSQPLSQAYISVFKGANIEQALNTAETNAARISGQPISNG

SEQ ID NO: 642 - DNA, 1341 bp, Artificial
  Substituion in SEQ ID NO 631
atgcgcgcgaagaagattagatatgcgacaatggctgcatctgtagcgatggcgggaatcatggcttccggctgcgggacaagtaccgcatcaaggaccggcactgcgccgacccaacaggaaagcgcttcgactcaccagcccgtgacgattacggtggcctcctggaacgatgctgcagactccttgagggcagagatcccaggattcgaaaaaaaatacccatggattaaagtgaacgtggaatatgtggatgggacgtatcagaaggtgatcccagaacttgttgccggagacgcacctgatatcatccaggttcagcaacgagattttcaaactttcctccataagtttccgggagattttgtcgatttgactccgtacatgagctcaatcaaaaatcatatagctcctgtcgcgctggacgtaactgtgcaaaacggtcatatctacgctgctccgtgggatctggggccggctgcgttgtattaccgaaaggacctgttccgcgaagcgggaattaatccaacttcaattaagacctggtctgattaccttgctgcgggtaagaagttagtcgcacattttcatggaaaggttaagatgctagctgagaacacgtcggagccaagccaaggcattcagacgaccctcatgatcttggtcaatgagcttggcggaagttatgtgaatcagaacggagatattgatttcttaaaccctcaactcgagaaggccatgagtgtgattcagcagtggggtaaggcagggattgtggcggatgcacctacgtggaacgacggtatcgctgcgtttgccaatggacaggttgccacgattctgtcggccgtttggtatgccggcactatgatgaatagtgcgcccaagcaaagtggtttgtggggcattgttccgcttccggcattcacgcctggtgggaacaatgaagctgatacgggtggctctgttttggcaattacgaaagacagcaagaatgttcaggcggcctgggacttcattaattactgtttgtataccgtcccgggagagaatgttcagttgaaatacggtctgttcccttcgtgggattcgtactatacggctaagggtactgactttgatcagaatttcccttacttcggaatgccgatctataagttcttcgcatccgtatcgaagcacattccgactaccaactatggtggctatttcgaggattactctcaaccgctatcacaagcttacatttcggtatttaagggcgcgaatatcgaacaagcgcttcagactgccgaaacgaatgccgcacgtatctctggtcaacccatttcaaatggataa

SEQ ID NO: 643 - DNA, 1341 bp, Artificial
  Substituion in SEQ ID NO 631
atgcgcgcgaagaagattagatatgcgacaatggctgcatctgtagcgatggcgggaatcatggcttccggctgcgggacaagtaccgcatcaaggaccggcactgcgccgacccaacaggaaagcgcttcgactcaccagcccgtgacgattacggtggcctcctggaacgatgctgcagactccttgagggcagagatcccaggattcgaaaaaaaatacccatggattaaagtgaacgtggaatatgtggatgggacgtatcagaaggtgatcccagaacttgttgccggagacgcacctgatatcatccaggttcagcaacgagattttcaaactttcctccataagtttccgggagattttgtcgatttgactccgtacatgagctcaatcaaaaatcatatagctcctgtcgcgctggacgtaactgtgcaaaacggtcatatctacgctgctccgtgggatctggggccggctgcgttgtattaccgaaaggacctgttccgcgaagcgggaattaatccaacttcaattaagacctggtctgattaccttgctgcgggtaagaagttagtcgcacattttcatggaaaggttaagatgctagctgagaacacgtcggagccaagccaaggcattcagacgaccctcatgatcttggtcaatgagcttggcggaagttatgtgaatcagaacggagatattgatttcttaaaccctcaactcgagaaggccatgagtgtgattcagcagtggggtaaggcagggattgtggcggatgcacctacgtggaacgacggtttagctgcgtttgccaatggacaggttgccacgattctgtcggccgtttggtatgccggcactatgatgaatagtgcgcccaagcaaagtggtttgtggggcattgttccgcttccggcattcacgcctggtgggaacaatgaagctgatacgggtggctctgttttggcaattacgaaagacagcaagaatgttcaggcggcctgggacttcattaattactgtttgtataccgtcccgggagagaatgttcagttgaaatacggtctgttcccttcgtgggagtcgtactatacggctaagggtactgactttgatcagaatttcccttacttcggaatgccgatctataagttcttcgcatccgtatcgaagcacattccgactaccaactatggtggctatttcgaggattactctcaaccgctatcacaagcttacatttcggtatttaagggcgcgaatatcgaacaagcgcttcagactgccgaaacgaatgccgcacgtatctctggtcaacccatttcaaatggataa

SEQ ID NO: 644 - DNA, 1341 bp, Artificial
  Substituion in SEQ ID NO 631
atgcgcgcgaagaagattagatatgcgacaatggctgcatctgtagcgatggcgggaatcatggcttccggctgcgggacaagtaccgcatcaaggaccggcactgcgccgacccaacaggaaagcgcttcgactcaccagcccgtgacgattacggtggcctcctggaacgatgctgcagactccttgagggcagagatcccaggattcgaaaaaaaatacccatggattaaagtgaacgtggaatatgtggatgggacgtatcagcgtgtgatcccagaacttgttgccggagacgcacctgatatcatccaggttcagcaacgagattttcaaactttcctccataagtttccgggagattttgtcgatttgactccgtacatgagctcaatcaaaaatcatatagctcctgtcgcgctggacgtaactgtgcaaaacggtcatatctacgctgctccgtgggatctggggccggctgcgttgtattaccgaaaggacctgttccgcgaagcgggaattaatccaacttcaattaagacctggtctgattaccttgctgcgggtaagaagttagtcgcacattttcatggaaaggttaagatgctagctgagaacacgtcggagccaagccaaggcattcagacgaccctcatgatcttggtcaatgagcttggcggaagttatgtgaatcagaacggagatattgatttcttaaaccctcaactcgagaaggccatgagtgtgattcagcagtggggtaaggcagggattgtggcggatgcacctacgtggaacgacggtatcgctgcgtttgccaatggacaggttgccacgattctgtcggccgtttggtatgccggcactatgatgaatagtgcgcccaagcaaagtggtttgtggggcattgttccgcttccggcattcacgcctggtgggaacaatgaagctgatacgggtggctctgttttggcaattacgaaagacagcaagaatgttcaggcggcctgggacttcattaattactgtttgtataccgtcccgggagagaatgttcagttgaaatacggtctgttcccttcgtgggagtcgtactatacggctaagggtactgactttgatcagaatttcccttacttcggaatgccgatctataagttcttcgcatccgtatcgaagcacattccgactaccaactatggtggctatttcgaggattactctcaaccgctatcacaagcttacatttcggtatttaagggcgcgaatatcgaacaagcgcttcagactgccgaaacgaatgccgcacgtatctctggtcaacccatttcaaatggataa

SEQ ID NO: 645 - DNA, 1341 bp, Artificial
  Substituion in SEQ ID NO 631
atgcgcgcgaagaagattagatatgcgacaatggctgcatctgtagcgatggcgggaatcatggcttccggctgcgggacaagtaccgcatcaaggaccggcactgcgccgacccaacaggaaagcgcttcgactcaccagcccgtgacgattacggtggcctcctggaacgatgctgcagactccttgagggcagagatcccaggattcgaaaaaaaatacccatggattaaagtgaacgtggaatatgtggatgggacgtatcagaaggtgatcccagaacttgttgccggagacgcacctgatatcatccaggttcagcaacgagattttcaaactttcctccataagtttccgggagattttgtcgatttgactccgtacatgagctcaatcaaaaatcatatagctcctgtcgcgattgacgtaactgtgcaaaacggtcatatctacgctgctccgtgggatctggggccggctgcgttgtattaccgaaaggacctgttccgcgaagcgggaattaatccaacttcaattaagacctggtctgattaccttgctgcgggtaagaagttagtcgcacattttcatggaaaggttaagatgctagctgagaacacgtcggagccaagccaaggcattcagacgaccctcatgatcttggtcaatgagcttggcggaagttatgtgaatcagaacggagatattgatttcttaaaccctcaactcgagaaggccatgagtgtgattcagcagtggggtaaggcagggattgtggcggatgcacctacgtggaacgacggtatcgctgcgtttgccaatggacaggttgccacgattctgtcggccgtttggtatgccggcactatgatgaatagtgcgcccaagcaaagtggtttgtggggcattgttccgcttccggcattcacgcctggtgggaacaatgaagctgatacgggtggctctgttttggcaattacgaaagacagcaagaatgttcaggcggcctgggacttcattaattactgtttgtataccgtcccgggagagaatgttcagttgaaatacggtctgttcccttcgtgggagtcgtactatacggctaagggtactgactttgatcagaatttcccttacttcggaatgccgatctataagttcttcgcatccgtatcgaagcacattccgactaccaactatggtggctatttcgaggattactctcaaccgctatcacaagcttacatttcggtatttaagggcgcgaatatcgaacaagcgcttcagactgccgaaacgaatgccgcacgtatctctggtcaacccatttcaaatggataa

SEQ ID NO: 646 - DNA, 1341 bp, Artificial
  Substituion in SEQ ID NO 631
atgcgcgcgaagaagattagatatgcgacaatggctgcatctgtagcgatggcgggaatcatggcttccggctgcgggacaagtaccgcatcaaggaccggcactgcgccgacccaacaggaaagcgcttcgactcaccagcccgtgacgattacggtggcctcctggaacgatgctgcagactccttgagggcagagatcccaggattcgaaaaaaaatacccatggattaaagtgaacgtggaatatgtggatgggacgtatcagaaggtgatcccagaacttgttgccggagacgcacctgatatcatccaggttcagcaacgagattttcaaactttcctccataagtttccgggagattttgtcgatttgactccgtacatgagctcaatcaaaaatcatatagctcctgtcgcgctggacgtaactgtgcaaaacggtcatatctacgctgctccgtgggatctggggccggctgcgttgtattaccgaaaggacctgttccgcgaagcgggaattaatccaacttcaattaagacctggtctgattaccttgctgcgggtaagaagttagtcgcacattttcatggaaaggttaagatgctagctgagaacacgtcggagccaagccaaggcattcagacgaccctcatgatcttggtcaatgagcttggcggaagttatgtgaatcagaacggagatattgatttcttaaaccctcaactcgagaaggccatgagtgtgattcagcagtggggtaaggcagggattgtggcggatgcacctacgtggaacgacggtatcgctgcgtttgccaatggacaggttgccacgattctgtcggccgtttggtatgccggcactatgatgaatagtgcgcccaagcaaagtggtttgtggggcattgttccgcttccggcattcacgcctggtgggaacaatgaagctgatacgggtggctctgttttggcaattacgaaagacagcaagaatgttcaggcggcctgggacttcattaattactgtttgtataccgtcccgggagagaatgttcagttgaaatacggtctgttcccttcgtgggagtcgtactatacggctaagggtactgactttgatcagaatttcccttacttcggaatgccgatctataagttcttcgcatccgtatcgaagcacattccgactaccaactatggtggctatttcgaggattactctcaaccgctatcacaagcttacatttcggtatttaagggcgcgaatatcgaacaagcgcttaatactgccgaaacgaatgccgcacgtatctctggtcaacccatttcaaatggataa

SEQ ID NO: 647 - protein, 315 aa, Alicyclobacillus acidocaldarius
MSTIQRESVVTERGTRSLTQLLRFLRQPGVPLWIPYVFITPFFIIFAVFMLYPIVDTLVLSFENWSTVQSTWVGIQNYRLVITDPAFWTSLLNDAFILLIQVPFMLFIATLLAVALNARFLKLKWLFRLLIFFPVLVDAVTYTIAFQLIFNPSFGMMNYLLHLVGLPSINWIGNSWAARLAIFLVVTWRWTGYNAIIILSGLQNIPEEVYESAVVDGAGRVRTFFQITLPLLRPVILFCTILSTVGTLQLFTEPYILTGGGPGNATETPMLYLYNIGFQNYNFGLASAGTYILTTIIAILSYFQIRVSRGGDYSA

SEQ ID NO: 648 - DNA, 948 bp, Alicyclobacillus acidocaldarius
gtgtctactattcagcgagaatccgtcgtcacagagagaggaactcgctcgctaacgcagctattgcgttttctgcggcaacctggcgttcctttgtggataccttatgtgttcattactccctttttcatcatatttgctgtttttatgctctatccgattgtcgatactttggtcctctcctttgaaaactggtccactgttcagtcgacatgggttggaattcaaaattatcgactcgtgataacagacccagcgttttggacttctctactgaatgacgccttcattctgcttattcaagttccgtttatgttgttcattgctacactcctagcggtcgctttgaatgcgcgctttctcaagctgaagtggctgttcaggctcctgatcttcttcccggttctggtggacgcggtaacgtacacgatagcatttcagttaatttttaatcctagtttcgggatgatgaactaccttctgcaccttgtagggctgccgtctatcaactggatagggaactcgtgggctgcacggttggctatttttcttgtggtgacatggagatggactggatataacgcgattatcatactgtccggccttcaaaacattcctgaggaggtatatgaatctgccgtcgtcgacggagcaggacgcgtgcgtacgttcttccaaatcaccttgcctttgctgcgtccggtgattctcttctgtacgatcttatcgaccgttggtaccttacagcttttcacggaaccgtacattctaacaggcggtggccccgggaatgcaacagaaacaccaatgttgtatttgtataacataggatttcagaactataacttcggtctcgcttcggcaggaacgtacatcttaacgacgattattgccatactctcgtattttcagataagagtctctcgtgggggcgactacagtgcgtga

SEQ ID NO: 649 - protein, 274 aa, Thermus brockianus
PFLFLTPYALLFAVFWAWPIAYSLYLSFLNTRVYPWRLEVGVNWGRLLQDPFFWTALKNTLFILLVQVPLMLALALLALALNSALLRAKGFFRFAFFAPVVVGAVAYSAVFRLLFNTEFGAVNALLRTLGHPGYDWLYAPGPAMAVIIIALTWRWTGYNAIILLAGLQSIPKELYEAAALDGAGPWQRFWHVTLPGIRPVLLFALILSIIGTLQLFTEPFLITGGGPGNATMTLGVYLYQQGFRSFNFGYASAIAYTVALLAALFSFLQMRLWR

SEQ ID NO: 650 - protein, 275 aa, Thermus sp. A4
PYLFLAPYLVFFGLFWAWPIVYSFYLSFVNTRVYPWRLEPALNWGRLLQDPFFAVALKNTLFILAVQVPLMLALALLLALALNSALLRFKGFYRFAFFAPVVVGAVAYSAVFRLLFNTEFGAVNALLRALGHPGYDWLYAPGPAMAVIIVALTWRWTGYNAIILLAGLQNIPKELYEAAAIDGAGPWQQFRHVTLPGIRPVLLFCLVLSIIGTLQLFTEPFLITGGGPGNATMTLGLYLYQQGFRSFNFGYASTIAYTVALLAAAFSFVQLRLWR

SEQ ID NO: 651 - protein, 326 aa, Halorubrum lacusprofundi ATCC 49239
SRRAMRPVWDRVRFARQDLTAATPTLPRVAYLFIAPFFLLFSVFLAFPVFYTLYLSFFEYQGVGQGSLFWIDLGPVYIEIPQIAQLNFVGLGNYARLLGNDLFWQSMFNTSYILVIQVPLMIGLALALALALNASFLRLKGVFRTAIALPVSANLVAYSTVFLLLFNEQLGFLNYVLAGVGIGPVPWLTDGFWARNTIIAAVTWRWTGYNMIILLAGLQTIPQQLYEAAEIDGANRWEKFRYVTLPQLKPVMLFVVVLSTIGTFKLFAEPYVITGGGPTNSTITIVQYIYRQAFVNFNLGYASALTVVFVAVVSVFSVVQIKIGGE

SEQ ID NO: 652 - protein, 275 aa, Rhizobium leguminosarum bv. viciae 3841
YAFLAPYLLIFATFWVWPIINSFLISFQNTRINPWKYSFQANWGRLFYDPAFYNALYNTLIILVIQVPVMIALATVMAVMLNSPLLKARPLFRFAFFAPVVVGEVAYAAVFRLMFSLDFGIINKLISAVGLSPVSWFDNANAAMALIILAVTWRWAGYNAIIILAGLQSIPDDVYEAATLDRVSKVQQFFHITLPLLKPIILFCVVLSVIGTMQLFTEPFLITNRGGPGGGTETLGLLLYRQGFTSLNFGYASAIAYTMAALAVSISLLNLWVGR

SEQ ID NO: 653 - protein, 277 aa, Agrobacterium tumefaciens str. C58
IAYAFLAPYLLIFATFWVWPIISSFMLSFQNTRINPWRFAPSMNWGRLVSDPAFYNALYNTLIILVIQVPVMIALATVMAVLLNSPLLKVRPLYRFAFFAPVVVGEVAYAAVFRLMFSADFGIINKLITSVGLSPISWFDNANAAMALVIIAVTWRWAGYNAIIILAGLQSIPGDVYEAATLDKVSKRQQFFHITLPLLKPIILFCVVLSVIGTMQLFAEPFLITNRGGPGGGTETLGLFLYRQGFTSLNFGYASAIAYTMAALAIAISLLNLWVGR

SEQ ID NO: 654 - protein, 315 aa, Artificial
  Substituion in SEQ ID NO 647
MSTIQRESVVTERGTRSLTQLLRFLRQPGVPLWIPYVFITPFFIIFAVFMLYPIVDTLVLSFENWSTVQSTWVGIQNYRLVITDPAFWTSLLNDAFILLIQVPFMLFIATLLAVALNARFLKLKWLFRLLIFFPVLVDAVTYTIAFQLIFNPSFGMMNYLLHLVGLPSINWIGNSWAARLAIFLVVTWRWTGYNAIIILSGLQNIPEEVYESAVVDGAGRVRTFFQLTLPLLRPVILFCTILSTVGTLQLFTEPYILTGGGPGNATETPMLYLYNIGFQNYNFGLASAGTYILTTIIAILSYFQIRVSRGGDYSA

SEQ ID NO: 655 - protein, 315 aa, Artificial
  Substituion in SEQ ID NO 647
MSTIQRESVVTERGTRSLTQLLRFLRQPGVPLWIPYVFITPFFIIFAVFMLYPIVDTLVLSFENWSTVQSTWIGIQNYRLVITDPAFWTSLLNDAFILLIQVPFMLFIATLLAVALNARFLKLKWLFRLLIFFPVLVDAVTYTIAFQLIFNPSFGMMNYLLHLVGLPSINWIGNSWAARLAIFLVVTWRWTGYNAIIILSGLQNIPEEVYESAVVDGAGRVRTFFQITLPLLRPVILFCTILSTVGTLQLFTEPYILTGGGPGNATETPMLYLYNIGFQNYNFGLASAGTYILTTIIAILSYFQIRVSRGGDYSA

SEQ ID NO: 656 - protein, 315 aa, Artificial
  Substituion in SEQ ID NO 647
MSTIQRESVVTERGTRSLTQLLRFLRQPGVPLWIPYVFITPFFIIFAVFMLYPIVDTLVLSFENWSTVQSTWVGINNYRLVITDPAFWTSLLNDAFILLIQVPFMLFIATLLAVALNARFLKLKWLFRLLIFFPVLVDAVTYTIAFQLIFNPSFGMMNYLLHLVGLPSINWIGNSWAARLAIFLVVTWRWTGYNAIIILSGLQNIPEEVYESAVVDGAGRVRTFFQITLPLLRPVILFCTILSTVGTLQLFTEPYILTGGGPGNATETPMLYLYNIGFQNYNFGLASAGTYILTTIIAILSYFQIRVSRGGDYSA

SEQ ID NO: 657 - protein, 315 aa, Artificial
  Substituion in SEQ ID NO 647
MSTIQRESVVTERGTRSLTQLLRFLRQPGVPLWIPYVFITPFFIIFAVFMIYPIVDTLVLSFENWSTVQSTWVGIQNYRLVITDPAFWTSLLNDAFILLIQVPFMLFIATLLAVALNARFLKLKWLFRLLIFFPVLVDAVTYTIAFQLIFNPSFGMMNYLLHLVGLPSINWIGNSWAARLAIFLVVTWRWTGYNAIIILSGLQNIPEEVYESAVVDGAGRVRTFFQITLPLLRPVILFCTILSTVGTLQLFTEPYILTGGGPGNATETPMLYLYNIGFQNYNFGLASAGTYILTTIIAILSYFQIRVSRGGDYSA

SEQ ID NO: 658 - protein, 315 aa, Artificial
  Substituion in SEQ ID NO 647
MSTIQRESVVTERGTRSLTQLLRFLRNPGVPLWIPYVFITPFFIIFAVFMLYPIVDTLVLSFENWSTVQSTWVGIQNYRLVITDPAFWTSLLNDAFILLIQVPFMLFIATLLAVALNARFLKLKWLFRLLIFFPVLVDAVTYTIAFQLIFNPSFGMMNYLLHLVGLPSINWIGNSWAARLAIFLVVTWRWTGYNAIIILSGLQNIPEEVYESAVVDGAGRVRTFFQITLPLLRPVILFCTILSTVGTLQLFTEPYILTGGGPGNATETPMLYLYNIGFQNYNFGLASAGTYILTTIIAILSYFQIRVSRGGDYSA

SEQ ID NO: 659 - DNA, 948 bp, Artificial
  Substituion in SEQ ID NO 648
gtgtctactattcagcgagaatccgtcgtcacagagagaggaactcgctcgctaacgcagctattgcgttttctgcggcaacctggcgttcctttgtggataccttatgtgttcattactccctttttcatcatatttgctgtttttatgctctatccgattgtcgatactttggtcctctcctttgaaaactggtccactgttcagtcgacatgggttggaattcaaaattatcgactcgtgataacagacccagcgttttggacttctctactgaatgacgccttcattctgcttattcaagttccgtttatgttgttcattgctacactcctagcggtcgctttgaatgcgcgctttctcaagctgaagtggctgttcaggctcctgatcttcttcccggttctggtggacgcggtaacgtacacgatagcatttcagttaatttttaatcctagtttcgggatgatgaactaccttctgcaccttgtagggctgccgtctatcaactggatagggaactcgtgggctgcacggttggctatttttcttgtggtgacatggagatggactggatataacgcgattatcatactgtccggccttcaaaacattcctgaggaggtatatgaatctgccgtcgtcgacggagcaggacgcgtgcgtacgttcttccaattaaccttgcctttgctgcgtccggtgattctcttctgtacgatcttatcgaccgttggtaccttacagcttttcacggaaccgtacattctaacaggcggtggccccgggaatgcaacagaaacaccaatgttgtatttgtataacataggatttcagaactataacttcggtctcgcttcggcaggaacgtacatcttaacgacgattattgccatactctcgtattttcagataagagtctctcgtgggggcgactacagtgcgtga

SEQ ID NO: 660 - DNA, 948 bp, Artificial
  Substituion in SEQ ID NO 648
gtgtctactattcagcgagaatccgtcgtcacagagagaggaactcgctcgctaacgcagctattgcgttttctgcggcaacctggcgttcctttgtggataccttatgtgttcattactccctttttcatcatatttgctgtttttatgctctatccgattgtcgatactttggtcctctcctttgaaaactggtccactgttcagtcgacatggattggaattcaaaattatcgactcgtgataacagacccagcgttttggacttctctactgaatgacgccttcattctgcttattcaagttccgtttatgttgttcattgctacactcctagcggtcgctttgaatgcgcgctttctcaagctgaagtggctgttcaggctcctgatcttcttcccggttctggtggacgcggtaacgtacacgatagcatttcagttaatttttaatcctagtttcgggatgatgaactaccttctgcaccttgtagggctgccgtctatcaactggatagggaactcgtgggctgcacggttggctatttttcttgtggtgacatggagatggactggatataacgcgattatcatactgtccggccttcaaaacattcctgaggaggtatatgaatctgccgtcgtcgacggagcaggacgcgtgcgtacgttcttccaaatcaccttgcctttgctgcgtccggtgattctcttctgtacgatcttatcgaccgttggtaccttacagcttttcacggaaccgtacattctaacaggcggtggccccgggaatgcaacagaaacaccaatgttgtatttgtataacataggatttcagaactataacttcggtctcgcttcggcaggaacgtacatcttaacgacgattattgccatactctcgtattttcagataagagtctctcgtgggggcgactacagtgcgtga

SEQ ID NO: 661 - DNA, 948 bp, Artificial
  Substituion in SEQ ID NO 648
gtgtctactattcagcgagaatccgtcgtcacagagagaggaactcgctcgctaacgcagctattgcgttttctgcggcaacctggcgttcctttgtggataccttatgtgttcattactccctttttcatcatatttgctgtttttatgctctatccgattgtcgatactttggtcctctcctttgaaaactggtccactgttcagtcgacatgggttggaattaataattatcgactcgtgataacagacccagcgttttggacttctctactgaatgacgccttcattctgcttattcaagttccgtttatgttgttcattgctacactcctagcggtcgctttgaatgcgcgctttctcaagctgaagtggctgttcaggctcctgatcttcttcccggttctggtggacgcggtaacgtacacgatagcatttcagttaatttttaatcctagtttcgggatgatgaactaccttctgcaccttgtagggctgccgtctatcaactggatagggaactcgtgggctgcacggttggctatttttcttgtggtgacatggagatggactggatataacgcgattatcatactgtccggccttcaaaacattcctgaggaggtatatgaatctgccgtcgtcgacggagcaggacgcgtgcgtacgttcttccaaatcaccttgcctttgctgcgtccggtgattctcttctgtacgatcttatcgaccgttggtaccttacagcttttcacggaaccgtacattctaacaggcggtggccccgggaatgcaacagaaacaccaatgttgtatttgtataacataggatttcagaactataacttcggtctcgcttcggcaggaacgtacatcttaacgacgattattgccatactctcgtattttcagataagagtctctcgtgggggcgactacagtgcgtga

SEQ ID NO: 662 - DNA, 948 bp, Artificial
  Substituion in SEQ ID NO 648
gtgtctactattcagcgagaatccgtcgtcacagagagaggaactcgctcgctaacgcagctattgcgttttctgcggcaacctggcgttcctttgtggataccttatgtgttcattactccctttttcatcatatttgctgtttttatgatttatccgattgtcgatactttggtcctctcctttgaaaactggtccactgttcagtcgacatgggttggaattcaaaattatcgactcgtgataacagacccagcgttttggacttctctactgaatgacgccttcattctgcttattcaagttccgtttatgttgttcattgctacactcctagcggtcgctttgaatgcgcgctttctcaagctgaagtggctgttcaggctcctgatcttcttcccggttctggtggacgcggtaacgtacacgatagcatttcagttaatttttaatcctagtttcgggatgatgaactaccttctgcaccttgtagggctgccgtctatcaactggatagggaactcgtgggctgcacggttggctatttttcttgtggtgacatggagatggactggatataacgcgattatcatactgtccggccttcaaaacattcctgaggaggtatatgaatctgccgtcgtcgacggagcaggacgcgtgcgtacgttcttccaaatcaccttgcctttgctgcgtccggtgattctcttctgtacgatcttatcgaccgttggtaccttacagcttttcacggaaccgtacattctaacaggcggtggccccgggaatgcaacagaaacaccaatgttgtatttgtataacataggatttcagaactataacttcggtctcgcttcggcaggaacgtacatcttaacgacgattattgccatactctcgtattttcagataagagtctctcgtgggggcgactacagtgcgtga

SEQ ID NO: 663 - DNA, 948 bp, Artificial
  Substituion in SEQ ID NO 648
gtgtctactattcagcgagaatccgtcgtcacagagagaggaactcgctcgctaacgcagctattgcgttttctgcggaatcctggcgttcctttgtggataccttatgtgttcattactccctttttcatcatatttgctgtttttatgctctatccgattgtcgatactttggtcctctcctttgaaaactggtccactgttcagtcgacatgggttggaattcaaaattatcgactcgtgataacagacccagcgttttggacttctctactgaatgacgccttcattctgcttattcaagttccgtttatgttgttcattgctacactcctagcggtcgctttgaatgcgcgctttctcaagctgaagtggctgttcaggctcctgatcttcttcccggttctggtggacgcggtaacgtacacgatagcatttcagttaatttttaatcctagtttcgggatgatgaactaccttctgcaccttgtagggctgccgtctatcaactggatagggaactcgtgggctgcacggttggctatttttcttgtggtgacatggagatggactggatataacgcgattatcatactgtccggccttcaaaacattcctgaggaggtatatgaatctgccgtcgtcgacggagcaggacgcgtgcgtacgttcttccaaatcaccttgcctttgctgcgtccggtgattctcttctgtacgatcttatcgaccgttggtaccttacagcttttcacggaaccgtacattctaacaggcggtggccccgggaatgcaacagaaacaccaatgttgtatttgtataacataggatttcagaactataacttcggtctcgcttcggcaggaacgtacatcttaacgacgattattgccatactctcgtattttcagataagagtctctcgtgggggcgactacagtgcgtga

SEQ ID NO: 664 - protein, 275 aa, Alicyclobacillus acidocaldarius
MRESIPVRVLSYVFLVIAVVVSIYPIYWIYVASTLSDGQIFHFPPANWFGGHLLQNVRMLESTMPVWRDLANSIVVSGITTISVVFFSAMVGFAFAKYRFWAKSFLFFVVLITIMIPMQTTLIPLFIIVTKLHWENTYQGLIVPFLVNGFGVFFMRQQMQSFPSELLEASRIDGASEFYTFFRIVMPNMLPSMAALGILTFLQQWGNFIWPLIVINSRNMSTVPLMLEQLDQPGNVIHYGPIFAGAAIGLVPLMIVFVALQRYFISGMYSGSVKG

SEQ ID NO: 665 - DNA, 828 bp, Alicyclobacillus acidocaldarius
gtgcgtgaaagcatccctgtcagagttcttagttatgtgtttttagtcattgctgttgtcgtgtccatttaccctatttattggatatacgtcgcatcaaccttgtctgatggtcagatttttcactttccacctgctaattggtttgggggtcatctcctgcaaaatgtgcgtatgctcgagtccacaatgcctgtgtggagggacctggcaaatagtattgtagtctcaggtattactacgattagcgtggtgtttttctccgcaatggtgggcttcgcgtttgcgaagtaccgtttttgggcgaaatcttttctattctttgtagtgctaatcactatcatgatacctatgcaaacgacactcattcctctattcattattgtgactaaattacactgggagaatacttaccaaggtttgatagttccctttcttgtaaatggattcggtgtcttcttcatgaggcagcaaatgcaatcattcccctccgaattgcttgaggcctcgaggatagacggggccagcgagttttatacgttctttcgaattgtaatgccaaacatgctgccctctatggcagcgttgggcatcctcacatttctacaacaatggggcaattttatctggccgttgattgtaattaatagcagaaacatgtcgaccgttccgcttatgctcgagcaacttgaccaaccgggaaatgtcatacattacggtccaatttttgctggagcggctatcggtctagtaccactgatgatagtctttgttgctttgcagagatattttatatcgggtatgtacagtggttctgtaaagggatga

SEQ ID NO: 666 - protein, 262 aa, Bacillus selenitireducens MLS10
YTALMIGVILSTFPFYWMFIGATNPSGAIFSVPPNLLPGDHFMENFRNLNEGVGIIRVMMNSLIIALTFTFFSVMISASAGYAFAKYKFKGRDPIFFMLLLAIMIPYHVTLIPLFQLMADLGWLNTYRAVILPHLAYPFAIFLMRQNMRSVPDALIEAARVDGAGEFKIFFRVILPTMRPALAAVAIFLFMFQWNNFLWPLVALGDSSMHTLPVALSGLVGMSRIDYGQIMLGTTLSTLPIMIFFLLLQKQFISGILGGSVK

SEQ ID NO: 667 - protein, 266 aa, Halorubrum lacusprofundi ATCC 49239
RFLTYAFVITMVVVMMVPLYWMLVAATLPQEQFLQFPPRLIPGTAFLDNFAALQERLDFVRTIRNSVLIAVVYTLLSLVLCSMAGFAFAKYEFKFKEPIFYTILATLVLPIQLLVIPLFLLMAQLDWTNTFRAIILPWAANPIGIFLMRQNMKSIPDALLESARMDGATEFQIFYRIALPTMRSSLAALAIILFLFQWDLFLYPLVILETADMYTIPIGLAQLTGFQRIYYDQIMVAATLAIVPMVVLFLVLQKQFVSGILAGSLK

SEQ ID NO: 668 - protein, 267 aa, Halothermothrix orenii H 168
KALLYFILIFGVLITFFPFYYMIVLATRSVEEIFNFPPPLWFGNAAQENIQILLDKLPFFQNIFNSIIVATLATLLVLFFCSLGGYGFAKYNFRGKEKLFFLMLASMMIPPLLSIIPWFIMMKAFGWINSFKPLIIPGAANAFGIFLMRQFMEEIPDEIIDAARIDGAGEFEIYYKIALPLSKPGMATLGILTFLGSWNNFMGPLLVLQEKTKYTIPVALSKLNGNFETPWGATMMGTALGVFPIVLAFVLASKYFISGLTTGATKG

SEQ ID NO: 669 - protein, 262 aa, Bacillus clausii KSM-K16
YVVLAAGLFITLGPFYWMVVGATNSSGALLSVPPNVIPGTHLLENARNLLNNIDIFRALWNSIFITVTFTVIAGLFSAAAGYAFAKYEFKGKNAIFSMFLVSMMIPYQALIIPQFELFARMGILNSYSAIILPQLAYPFAIFLMRQSMKSIPDSVLESARIDGCGEYRMFFQIALPTMLPAIGAVGIFLFTHQWNNFLWPLVVIVTEDMYTLPIVLSILGGQDNLDYGQLMLAATISVLPIFIMFLFLQRYFIAGISSGAVK

SEQ ID NO: 670 - protein, 268 aa, Herpetosiphon aurantiacus ATCC 23779
YLLLVVGAFLSLFPFYYMFVQASQPSSEVLRFPPHLWFGSAAWSNIQGLFANGFGRSLFNSAFIAVVYASLSVFIASLAGYAFAKFRFRGRSILFGMFLLVLMIPYHVTAVPLFQLMAKITLFGDPTWISSYQAVILPALANPFGIFLMRQSMQSLPDDLLDAARIDGAGEWRVFTSVALPTMRPTLAALAIYSFMFQWNSFFWPLIIMRDKAMETLPVRINALVGLSIIDYGQLMMGTALTTLPIMMIFIAFQRQFISGALAGAVKG

SEQ ID NO: 671 - protein, 275 aa, Artificial
  Substituion in SEQ ID NO 664
MRESIPVRVLSYVFLVIAVVVSIYPIYWIYVASTLSEGQIFHFPPANWFGGHLLQNVRMLESTMPVWRDLANSIVVSGITTISVVFFSAMVGFAFAKYRFWAKSFLFFVVLITIMIPMQTTLIPLFIIVTKLHWENTYQGLIVPFLVNGFGVFFMRQQMQSFPSELLEASRIDGASEFYTFFRIVMPNMLPSMAALGILTFLQQWGNFIWPLIVINSRNMSTVPLMLEQLDQPGNVIHYGPIFAGAAIGLVPLMIVFVALQRYFISGMYSGSVKG

SEQ ID NO: 672 - protein, 275 aa, Artificial
  Substituion in SEQ ID NO 664
MRESIPVRVLSYVFLVIAVVVSIYPIYWIYVASTLSDGQIFHFPPANWFGGHLLQNVRMLESTMPVWRDLANSIVVSGITTISVVFFSAMVGFAFAKYRFWAKSFLFFVVLITIMIPMQTTLIPLFIIVTKLHWEQTYQGLIVPFLVNGFGVFFMRQQMQSFPSELLEASRIDGASEFYTFFRIVMPNMLPSMAALGILTFLQQWGNFIWPLIVINSRNMSTVPLMLEQLDQPGNVIHYGPIFAGAAIGLVPLMIVFVALQRYFISGMYSGSVKG

SEQ ID NO: 673 - protein, 275 aa, Artificial
  Substituion in SEQ ID NO 664
MRESIPVRVLSYVFLIIAVVVSIYPIYWIYVASTLSDGQIFHFPPANWFGGHLLQNVRMLESTMPVWRDLANSIVVSGITTISVVFFSAMVGFAFAKYRFWAKSFLFFVVLITIMIPMQTTLIPLFIIVTKLHWENTYQGLIVPFLVNGFGVFFMRQQMQSFPSELLEASRIDGASEFYTFFRIVMPNMLPSMAALGILTFLQQWGNFIWPLIVINSRNMSTVPLMLEQLDQPGNVIHYGPIFAGAAIGLVPLMIVFVALQRYFISGMYSGSVKG

SEQ ID NO: 674 - protein, 275 aa, Artificial
  Substituion in SEQ ID NO 664
MRESIPVRVLSYVFLVIAVVVSIYPIYWLYVASTLSDGQIFHFPPANWFGGHLLQNVRMLESTMPVWRDLANSIVVSGITTISVVFFSAMVGFAFAKYRFWAKSFLFFVVLITIMIPMQTTLIPLFIIVTKLHWENTYQGLIVPFLVNGFGVFFMRQQMQSFPSELLEASRIDGASEFYTFFRIVMPNMLPSMAALGILTFLQQWGNFIWPLIVINSRNMSTVPLMLEQLDQPGNVIHYGPIFAGAAIGLVPLMIVFVALQRYFISGMYSGSVKG

SEQ ID NO: 675 - protein, 275 aa, Artificial
  Substituion in SEQ ID NO 664
MRESIPVRVLSYVFLVIAVVVSIYPIYWIYVASTLSDGQIFHFPPANWFGGHLLQNVRMLESTMPVWRDLANSIVVSGITTISVVFFSAMVGFAFAKYRFWAKSFLFFVVLITIMIPMQTTLIPLFIIVTKLHWENTYQGLIVPFLVNGFGVFFMRQQMQSFPSELLEASRIDGASEFYTFFRIVMPQMLPSMAALGILTFLQQWGNFIWPLIVINSRNMSTVPLMLEQLDQPGNVIHYGPIFAGAAIGLVPLMIVFVALQRYFISGMYSGSVKG

SEQ ID NO: 676 - DNA, 828 bp, Artificial
  Substituion in SEQ ID NO 665
gtgcgtgaaagcatccctgtcagagttcttagttatgtgtttttagtcattgctgttgtcgtgtccatttaccctatttattggatatacgtcgcatcaaccttgtctgaaggtcagatttttcactttccacctgctaattggtttgggggtcatctcctgcaaaatgtgcgtatgctcgagtccacaatgcctgtgtggagggacctggcaaatagtattgtagtctcaggtattactacgattagcgtggtgtttttctccgcaatggtgggcttcgcgtttgcgaagtaccgtttttgggcgaaatcttttctattctttgtagtgctaatcactatcatgatacctatgcaaacgacactcattcctctattcattattgtgactaaattacactgggagaatacttaccaaggtttgatagttccctttcttgtaaatggattcggtgtcttcttcatgaggcagcaaatgcaatcattcccctccgaattgcttgaggcctcgaggatagacggggccagcgagttttatacgttctttcgaattgtaatgccaaacatgctgccctctatggcagcgttgggcatcctcacatttctacaacaatggggcaattttatctggccgttgattgtaattaatagcagaaacatgtcgaccgttccgcttatgctcgagcaacttgaccaaccgggaaatgtcatacattacggtccaatttttgctggagcggctatcggtctagtaccactgatgatagtctttgttgctttgcagagatattttatatcgggtatgtacagtggttctgtaaagggatga

SEQ ID NO: 677 - DNA, 828 bp, Artificial
  Substituion in SEQ ID NO 665
gtgcgtgaaagcatccctgtcagagttcttagttatgtgtttttagtcattgctgttgtcgtgtccatttaccctatttattggatatacgtcgcatcaaccttgtctgatggtcagatttttcactttccacctgctaattggtttgggggtcatctcctgcaaaatgtgcgtatgctcgagtccacaatgcctgtgtggagggacctggcaaatagtattgtagtctcaggtattactacgattagcgtggtgtttttctccgcaatggtgggcttcgcgtttgcgaagtaccgtttttgggcgaaatcttttctattctttgtagtgctaatcactatcatgatacctatgcaaacgacactcattcctctattcattattgtgactaaattacactgggagcaaacttaccaaggtttgatagttccctttcttgtaaatggattcggtgtcttcttcatgaggcagcaaatgcaatcattcccctccgaattgcttgaggcctcgaggatagacggggccagcgagttttatacgttctttcgaattgtaatgccaaacatgctgccctctatggcagcgttgggcatcctcacatttctacaacaatggggcaattttatctggccgttgattgtaattaatagcagaaacatgtcgaccgttccgcttatgctcgagcaacttgaccaaccgggaaatgtcatacattacggtccaatttttgctggagcggctatcggtctagtaccactgatgatagtctttgttgctttgcagagatattttatatcgggtatgtacagtggttctgtaaagggatga

SEQ ID NO: 678 - DNA, 828 bp, Artificial
  Substituion in SEQ ID NO 665
gtgcgtgaaagcatccctgtcagagttcttagttatgtgtttttaattattgctgttgtcgtgtccatttaccctatttattggatatacgtcgcatcaaccttgtctgatggtcagatttttcactttccacctgctaattggtttgggggtcatctcctgcaaaatgtgcgtatgctcgagtccacaatgcctgtgtggagggacctggcaaatagtattgtagtctcaggtattactacgattagcgtggtgtttttctccgcaatggtgggcttcgcgtttgcgaagtaccgtttttgggcgaaatcttttctattctttgtagtgctaatcactatcatgatacctatgcaaacgacactcattcctctattcattattgtgactaaattacactgggagaatacttaccaaggtttgatagttccctttcttgtaaatggattcggtgtcttcttcatgaggcagcaaatgcaatcattcccctccgaattgcttgaggcctcgaggatagacggggccagcgagttttatacgttctttcgaattgtaatgccaaacatgctgccctctatggcagcgttgggcatcctcacatttctacaacaatggggcaattttatctggccgttgattgtaattaatagcagaaacatgtcgaccgttccgcttatgctcgagcaacttgaccaaccgggaaatgtcatacattacggtccaatttttgctggagcggctatcggtctagtaccactgatgatagtctttgttgctttgcagagatattttatatcgggtatgtacagtggttctgtaaagggatga

SEQ ID NO: 679 - DNA, 828 bp, Artificial
  Substituion in SEQ ID NO 665
gtgcgtgaaagcatccctgtcagagttcttagttatgtgtttttagtcattgctgttgtcgtgtccatttaccctatttattggttatacgtcgcatcaaccttgtctgatggtcagatttttcactttccacctgctaattggtttgggggtcatctcctgcaaaatgtgcgtatgctcgagtccacaatgcctgtgtggagggacctggcaaatagtattgtagtctcaggtattactacgattagcgtggtgtttttctccgcaatggtgggcttcgcgtttgcgaagtaccgtttttgggcgaaatcttttctattctttgtagtgctaatcactatcatgatacctatgcaaacgacactcattcctctattcattattgtgactaaattacactgggagaatacttaccaaggtttgatagttccctttcttgtaaatggattcggtgtcttcttcatgaggcagcaaatgcaatcattcccctccgaattgcttgaggcctcgaggatagacggggccagcgagttttatacgttctttcgaattgtaatgccaaacatgctgccctctatggcagcgttgggcatcctcacatttctacaacaatggggcaattttatctggccgttgattgtaattaatagcagaaacatgtcgaccgttccgcttatgctcgagcaacttgaccaaccgggaaatgtcatacattacggtccaatttttgctggagcggctatcggtctagtaccactgatgatagtctttgttgctttgcagagatattttatatcgggtatgtacagtggttctgtaaagggatga

SEQ ID NO: 680 - DNA, 828 bp, Artificial
  Substituion in SEQ ID NO 665
gtgcgtgaaagcatccctgtcagagttcttagttatgtgtttttagtcattgctgttgtcgtgtccatttaccctatttattggatatacgtcgcatcaaccttgtctgatggtcagatttttcactttccacctgctaattggtttgggggtcatctcctgcaaaatgtgcgtatgctcgagtccacaatgcctgtgtggagggacctggcaaatagtattgtagtctcaggtattactacgattagcgtggtgtttttctccgcaatggtgggcttcgcgtttgcgaagtaccgtttttgggcgaaatcttttctattctttgtagtgctaatcactatcatgatacctatgcaaacgacactcattcctctattcattattgtgactaaattacactgggagaatacttaccaaggtttgatagttccctttcttgtaaatggattcggtgtcttcttcatgaggcagcaaatgcaatcattcccctccgaattgcttgaggcctcgaggatagacggggccagcgagttttatacgttctttcgaattgtaatgccacaaatgctgccctctatggcagcgttgggcatcctcacatttctacaacaatggggcaattttatctggccgttgattgtaattaatagcagaaacatgtcgaccgttccgcttatgctcgagcaacttgaccaaccgggaaatgtcatacattacggtccaatttttgctggagcggctatcggtctagtaccactgatgatagtctttgttgctttgcagagatattttatatcgggtatgtacagtggttctgtaaagggatga

SEQ ID NO: 681 - protein, 349 aa, Alicyclobacillus acidocaldarius
MKRFNWKSGKKYAAVAAAAASIVLAATGCSTGGGNSSTSSGSTGGSSSAFQGSSSETYYMVTFLSGIEYWKGCFAGMQAAAKDLGVKAVFTGAPQYDINQEVTTMQQVIAKHPAGILVTSINAQAMTPVINQAIAAGIPVISFDSDAPQSKRYAYLGTSNIEAGQKAADYLGQALGGHGEVAVITTPGELNLDQRVQGFKDEMAAKYPGVKVVAVQNGNSDQIKTAQVTSALLQTYPNLAGIFCTEADEGTGAATAVQEAGKTGTVKIVSFDTDKATLNAIKSGQITATVAQGTWNMGFWGLMDLFAIHHNLVHPVANWQQSGVDPVPPEVDTGVTIVTKSNVNAYLQQ

SEQ ID NO: 682 - DNA, 1050 bp, Alicyclobacillus acidocaldarius
atgaaacggttcaactggaaatcgggaaagaaatacgcggcggttgcggcagctgctgcgtcgatcgtcttggctgcgacgggttgctcgacaggcggcggaaactcgtccacttcgtccggttcgacgggtggcagctcctcagcgttccagggttcatcgagcgaaacgtactacatggtgacgttcttgtcaggtatcgagtactggaagggatgcttcgccggcatgcaggcagccgccaaagaccttggcgtgaaggcggtatttactggagctcctcagtatgatatcaaccaagaagttacgaccatgcaacaggtcatcgcgaaacatcccgcgggtattctggtaacgtctatcaacgctcaggctatgacgcctgtcatcaaccaagccattgcggcaggtattcctgtcattagcttcgactcggacgcgcctcaaagcaagcggtacgcgtacctcggaaccagcaacatcgaagcggggcagaaggccgcggattatctgggacaagctctcggtggtcacggcgaagtggcagtcatcaccacgccgggagagctgaacttggaccaacgcgtacagggcttcaaagacgaaatggccgcgaagtatccgggggtcaaagtcgtcgccgtccagaacggcaactctgatcaaatcaaaaccgctcaagtcacgtctgcgttgctgcagacctatccaaatcttgcgggtatcttctgcaccgaggccgacgaaggtaccggcgctgcgaccgccgtgcaggaggcaggaaagacaggcacggtgaagattgtctcgttcgatacagacaaggcgacgctgaacgcgatcaagagcggacaaatcactgccactgtcgcgcagggcacatggaacatgggcttctggggcctcatggatttgtttgcgattcatcacaaccttgtgcatcctgtcgccaattggcagcagtccggtgttgatcccgtaccgcctgaagtggatactggcgtgacgatcgtgacgaagagcaacgtgaatgcgtacttgcaacaataa

SEQ ID NO: 683 - protein, 289 aa, Caldicellulosiruptor saccharolyticus DSM 8903
YYMVTFASGIEYWKGCFKGMKAAADLYGVKAIYTGAPQFDVNQQVTVLRQVIAKKPAGILVTCANPDALKAPIDEAIKKGIPVITFDADSPKSLRYSVLETGNYNAGAMAARYLGKLLGGKGEVGISTVAAQLNHEQRKQGFIDTLKKEFPGIKVVSIVNDENDSTKAARGVAAMLQAHPNIKGIFCTDAPGGVGVATAIKEANKVGKIKIVSFDTDKGTLDLIKQGVIDASIAQGTWNMGFWGMTFLFYLKHGIVNPVDNWKKFGINPLPPYVDTGTMVVTKQNVDAF

SEQ ID NO: 684 - protein, 288 aa, Bacillus halodurans C-125
YMMITFQSGMDYWKRCLKGFEDAAQALNVTVEYRGAAQYDIQEQITVLEQAIAKNPAGIAISAIDPVELTDTINKAVDAGIPIVLFDSGAPDSHAHSFLGTNNYNAGMNAAYKMAELLDGEGEVAVITLPNQLNHQERTTGFKETLEAEFPAIEVIAVEDGRGDSLHSRRVAHQLLEDYPNLAGIFATEANGGVGVGDAVRLESRAGEIQIISFDTDKGTLDLVDEGIISATLAQGTWNMGYWSLTYLFHLHHGLTEPQILQTREEAPLPLYVDTGITIVTDENVDYY

SEQ ID NO: 685 - protein, 284 aa, Geobacillus kaustophilus HTA426
YVMVTFQSGMDYWKRCLKGFEDAAEALNVSVEYRGATQYDVNEQVTVLEQVIARKPAGIAVSAINPTALTKTINKAVEEGIPVVLFDSNASGSKAFSFLGTNNYSAGVTAAHEMAKLLKNEGKVAIITSPHQLNHQERTRGFVETIYQKYPRMQVVAVKNGKGDAMASKQAAMEILKDYPDVQGIFATEANGGVGMAEAVKELNKKEIKLISFDTEKQTLDLVKGGVIAATLAQGTWNMGYWSLQFLFHLHHHLTSPSRSGDSPLPTYVDTGITVVTRENVDHF

SEQ ID NO: 686 - protein, 284 aa, Geobacillus thermodenitrificans NG80-2
YVMITFQSGMDYWKRCLKGFEDAAEELNVSVEYRGATQYDVNEQVTVLEQVIARKPAGIAISAINPTALTKTINKAVEKGIPVVLFDSNASGSKAFSFLGTNNYNAGVTAAHEMAKLLGNKGNVGIITSPYQLNHQERTRGFVETIYQKYPQMHVVAVKNGKGDVRASKQAAIEILKDYPDVQGIFATEANGGVGMAEAVVMLNKKHVKLISFDTEKQTLDLVKKGVIAATLAQGTWNMGYWSLQFLFQLHHRLTSSSRSGDLPLPVYVDTGITVVTKENVDRF

SEQ ID NO: 687 - protein, 280 aa, Bacillus licheniformis ATCC 14580
YVMVTFQSGIEYWKSGLKGFEDAAQLFNVSVEYRGAAHYDVHEQTTVLEQVIAKKPAGIAVSAINPKALNPVIDKAHEQGIPIVLFDSDAPLSKASTYIGTNNMEAGAVAARRMAEFLNGKGETAVITQPQQYNHQERTKGFEQTIKQKYPNMKVAAVLDGKGDELTSKKEAAKILEENPSIKGIFTTEANGASGVARAVKEAGLEGEVCIIGFDKDKKTLDGIKNGSISATMSQDTWQMGYWSLHMLFFSNHHLKHERPLPAAIDTGITIITKENVAAY

SEQ ID NO: 688 - protein, 349 aa, Artificial
  Substituion in SEQ ID NO 681
MKRFNWKSGKKYAAVAAAAASIVLAATGCSTGGGNSSTSSGSTGGSSSAFQGSSSETYYMVTFLSGIEYWKGCFAGMQAAAKDLGVKAVFTGAPQYDINQEVTTMQQVIAKHPAGILVTSINAQAMTPVINQAIAAGIPVISFDSDAPQSKRYAYLGTSNIEAGQKAADYLGQALGGHGEVAVITTPGELNLDQRVQGFKDEMAAKYPGVKVVAVQNGNSDQIKTAQITSALLQTYPNLAGIFCTEADEGTGAATAVQEAGKTGTVKIVSFDTDKATLNAIKSGQITATVAQGTWNMGFWGLMDLFAIHHNLVHPVANWQQSGVDPVPPEVDTGVTIVTKSNVNAYLQQ

SEQ ID NO: 689 - protein, 349 aa, Artificial
  Substituion in SEQ ID NO 681
MKRFNWKSGKKYAAVAAAAASIVLAATGCSTGGGNSSTSSGSTGGSSSAFQGSSSETYYMVTFLSGIEYWKGCFAGMQAAAKDLGVKAVFTGAPQYDINQEVTTMQQVIAKHPAGILVTSINAQAMTPVINQAIAAGIPVISFDSDAPQSKRYAYLGTSNIEAGQKAADYLGQALGGHGEVAVITTPGELNLDQRVQGFKDEMAAKYPGVKVVAVQNGNSDQIKTAQVTSALLQTYPNLAGIFCTEADEGTGAATAVQEAGKTGTVRIVSFDTDKATLNAIKSGQITATVAQGTWNMGFWGLMDLFAIHHNLVHPVANWQQSGVDPVPPEVDTGVTIVTKSNVNAYLQQ

SEQ ID NO: 690 - protein, 349 aa, Artificial
  Substituion in SEQ ID NO 681
MKRFNWKSGKKYAAVAAAAASIVLAATGCSTGGGNSSTSSGSTGGSSSAFQGSSSETYYMVTFLSGIDYWKGCFAGMQAAAKDLGVKAVFTGAPQYDINQEVTTMQQVIAKHPAGILVTSINAQAMTPVINQAIAAGIPVISFDSDAPQSKRYAYLGTSNIEAGQKAADYLGQALGGHGEVAVITTPGELNLDQRVQGFKDEMAAKYPGVKVVAVQNGNSDQIKTAQVTSALLQTYPNLAGIFCTEADEGTGAATAVQEAGKTGTVKIVSFDTDKATLNAIKSGQITATVAQGTWNMGFWGLMDLFAIHHNLVHPVANWQQSGVDPVPPEVDTGVTIVTKSNVNAYLQQ

SEQ ID NO: 691 - protein, 349 aa, Artificial
  Substituion in SEQ ID NO 681
MKRFNWKSGKKYAAVAAAAASIVLAATGCSTGGGNSSTSSGSTGGSSSAFQGSSSETYYMVTFLSGIEYWKGCFAGMQAAAKDLGVKAVFTGAPQYDINQEVTTMQQVIAKHPAGILVTSINAQAMTPVINQAIAAGIPVISFDSDAPQSKRYAYLGTSNIEAGQKAADYLGNALGGHGEVAVITTPGELNLDQRVQGFKDEMAAKYPGVKVVAVQNGNSDQIKTAQVTSALLQTYPNLAGIFCTEADEGTGAATAVQEAGKTGTVKIVSFDTDKATLNAIKSGQITATVAQGTWNMGFWGLMDLFAIHHNLVHPVANWQQSGVDPVPPEVDTGVTIVTKSNVNAYLQQ

SEQ ID NO: 692 - protein, 349 aa, Artificial
  Substituion in SEQ ID NO 681
MKRFNWKSGKKYAAVAAAAASIVLAATGCSTGGGNSSTSSGSTGGSSSAFQGSSSETYYMVTFLSGIEYWKGCFAGMQAAAKDLGVKAVFTGAPQYDINQEVTTMQQVIAKHPAGILVTSINAQAMTPVINQAIAAGIPVISFDSDAPQSKRYAYLGTSNIEAGQKAADYLGQALGGHGEVAVITTPGELNLDQRVQGFKDEMAAKYPGVKVVAVQNGNSDQIKTAQVTSALLQTYPNLAGIFCTEADEGTGAATAVQEAGKTGTVKIVSFDTDKATLNAIKSGQITATVAQGTWNMGFWGLMDLFALHHNLVHPVANWQQSGVDPVPPEVDTGVTIVTKSNVNAYLQQ

SEQ ID NO: 693 - DNA, 1050 bp, Artificial
  Substituion in SEQ ID NO 682
atgaaacggttcaactggaaatcgggaaagaaatacgcggcggttgcggcagctgctgcgtcgatcgtcttggctgcgacgggttgctcgacaggcggcggaaactcgtccacttcgtccggttcgacgggtggcagctcctcagcgttccagggttcatcgagcgaaacgtactacatggtgacgttcttgtcaggtatcgagtactggaagggatgcttcgccggcatgcaggcagccgccaaagaccttggcgtgaaggcggtatttactggagctcctcagtatgatatcaaccaagaagttacgaccatgcaacaggtcatcgcgaaacatcccgcgggtattctggtaacgtctatcaacgctcaggctatgacgcctgtcatcaaccaagccattgcggcaggtattcctgtcattagcttcgactcggacgcgcctcaaagcaagcggtacgcgtacctcggaaccagcaacatcgaagcggggcagaaggccgcggattatctgggacaagctctcggtggtcacggcgaagtggcagtcatcaccacgccgggagagctgaacttggaccaacgcgtacagggcttcaaagacgaaatggccgcgaagtatccgggggtcaaagtcgtcgccgtccagaacggcaactctgatcaaatcaaaaccgctcaaattacgtctgcgttgctgcagacctatccaaatcttgcgggtatcttctgcaccgaggccgacgaaggtaccggcgctgcgaccgccgtgcaggaggcaggaaagacaggcacggtgaagattgtctcgttcgatacagacaaggcgacgctgaacgcgatcaagagcggacaaatcactgccactgtcgcgcagggcacatggaacatgggcttctggggcctcatggatttgtttgcgattcatcacaaccttgtgcatcctgtcgccaattggcagcagtccggtgttgatcccgtaccgcctgaagtggatactggcgtgacgatcgtgacgaagagcaacgtgaatgcgtacttgcaacaataa

SEQ ID NO: 694 - DNA, 1050 bp, Artificial
  Substituion in SEQ ID NO 682
atgaaacggttcaactggaaatcgggaaagaaatacgcggcggttgcggcagctgctgcgtcgatcgtcttggctgcgacgggttgctcgacaggcggcggaaactcgtccacttcgtccggttcgacgggtggcagctcctcagcgttccagggttcatcgagcgaaacgtactacatggtgacgttcttgtcaggtatcgagtactggaagggatgcttcgccggcatgcaggcagccgccaaagaccttggcgtgaaggcggtatttactggagctcctcagtatgatatcaaccaagaagttacgaccatgcaacaggtcatcgcgaaacatcccgcgggtattctggtaacgtctatcaacgctcaggctatgacgcctgtcatcaaccaagccattgcggcaggtattcctgtcattagcttcgactcggacgcgcctcaaagcaagcggtacgcgtacctcggaaccagcaacatcgaagcggggcagaaggccgcggattatctgggacaagctctcggtggtcacggcgaagtggcagtcatcaccacgccgggagagctgaacttggaccaacgcgtacagggcttcaaagacgaaatggccgcgaagtatccgggggtcaaagtcgtcgccgtccagaacggcaactctgatcaaatcaaaaccgctcaagtcacgtctgcgttgctgcagacctatccaaatcttgcgggtatcttctgcaccgaggccgacgaaggtaccggcgctgcgaccgccgtgcaggaggcaggaaagacaggcacggtgcgtattgtctcgttcgatacagacaaggcgacgctgaacgcgatcaagagcggacaaatcactgccactgtcgcgcagggcacatggaacatgggcttctggggcctcatggatttgtttgcgattcatcacaaccttgtgcatcctgtcgccaattggcagcagtccggtgttgatcccgtaccgcctgaagtggatactggcgtgacgatcgtgacgaagagcaacgtgaatgcgtacttgcaacaataa

SEQ ID NO: 695 - DNA, 1050 bp, Artificial
  Substituion in SEQ ID NO 682
atgaaacggttcaactggaaatcgggaaagaaatacgcggcggttgcggcagctgctgcgtcgatcgtcttggctgcgacgggttgctcgacaggcggcggaaactcgtccacttcgtccggttcgacgggtggcagctcctcagcgttccagggttcatcgagcgaaacgtactacatggtgacgttcttgtcaggtatcgattactggaagggatgcttcgccggcatgcaggcagccgccaaagaccttggcgtgaaggcggtatttactggagctcctcagtatgatatcaaccaagaagttacgaccatgcaacaggtcatcgcgaaacatcccgcgggtattctggtaacgtctatcaacgctcaggctatgacgcctgtcatcaaccaagccattgcggcaggtattcctgtcattagcttcgactcggacgcgcctcaaagcaagcggtacgcgtacctcggaaccagcaacatcgaagcggggcagaaggccgcggattatctgggacaagctctcggtggtcacggcgaagtggcagtcatcaccacgccgggagagctgaacttggaccaacgcgtacagggcttcaaagacgaaatggccgcgaagtatccgggggtcaaagtcgtcgccgtccagaacggcaactctgatcaaatcaaaaccgctcaagtcacgtctgcgttgctgcagacctatccaaatcttgcgggtatcttctgcaccgaggccgacgaaggtaccggcgctgcgaccgccgtgcaggaggcaggaaagacaggcacggtgaagattgtctcgttcgatacagacaaggcgacgctgaacgcgatcaagagcggacaaatcactgccactgtcgcgcagggcacatggaacatgggcttctggggcctcatggatttgtttgcgattcatcacaaccttgtgcatcctgtcgccaattggcagcagtccggtgttgatcccgtaccgcctgaagtggatactggcgtgacgatcgtgacgaagagcaacgtgaatgcgtacttgcaacaataa

SEQ ID NO: 696 - DNA, 1050 bp, Artificial
  Substituion in SEQ ID NO 682
atgaaacggttcaactggaaatcgggaaagaaatacgcggcggttgcggcagctgctgcgtcgatcgtcttggctgcgacgggttgctcgacaggcggcggaaactcgtccacttcgtccggttcgacgggtggcagctcctcagcgttccagggttcatcgagcgaaacgtactacatggtgacgttcttgtcaggtatcgagtactggaagggatgcttcgccggcatgcaggcagccgccaaagaccttggcgtgaaggcggtatttactggagctcctcagtatgatatcaaccaagaagttacgaccatgcaacaggtcatcgcgaaacatcccgcgggtattctggtaacgtctatcaacgctcaggctatgacgcctgtcatcaaccaagccattgcggcaggtattcctgtcattagcttcgactcggacgcgcctcaaagcaagcggtacgcgtacctcggaaccagcaacatcgaagcggggcagaaggccgcggattatctgggaaatgctctcggtggtcacggcgaagtggcagtcatcaccacgccgggagagctgaacttggaccaacgcgtacagggcttcaaagacgaaatggccgcgaagtatccgggggtcaaagtcgtcgccgtccagaacggcaactctgatcaaatcaaaaccgctcaagtcacgtctgcgttgctgcagacctatccaaatcttgcgggtatcttctgcaccgaggccgacgaaggtaccggcgctgcgaccgccgtgcaggaggcaggaaagacaggcacggtgaagattgtctcgttcgatacagacaaggcgacgctgaacgcgatcaagagcggacaaatcactgccactgtcgcgcagggcacatggaacatgggcttctggggcctcatggatttgtttgcgattcatcacaaccttgtgcatcctgtcgccaattggcagcagtccggtgttgatcccgtaccgcctgaagtggatactggcgtgacgatcgtgacgaagagcaacgtgaatgcgtacttgcaacaataa

SEQ ID NO: 697 - DNA, 1050 bp, Artificial
  Substituion in SEQ ID NO 682
atgaaacggttcaactggaaatcgggaaagaaatacgcggcggttgcggcagctgctgcgtcgatcgtcttggctgcgacgggttgctcgacaggcggcggaaactcgtccacttcgtccggttcgacgggtggcagctcctcagcgttccagggttcatcgagcgaaacgtactacatggtgacgttcttgtcaggtatcgagtactggaagggatgcttcgccggcatgcaggcagccgccaaagaccttggcgtgaaggcggtatttactggagctcctcagtatgatatcaaccaagaagttacgaccatgcaacaggtcatcgcgaaacatcccgcgggtattctggtaacgtctatcaacgctcaggctatgacgcctgtcatcaaccaagccattgcggcaggtattcctgtcattagcttcgactcggacgcgcctcaaagcaagcggtacgcgtacctcggaaccagcaacatcgaagcggggcagaaggccgcggattatctgggacaagctctcggtggtcacggcgaagtggcagtcatcaccacgccgggagagctgaacttggaccaacgcgtacagggcttcaaagacgaaatggccgcgaagtatccgggggtcaaagtcgtcgccgtccagaacggcaactctgatcaaatcaaaaccgctcaagtcacgtctgcgttgctgcagacctatccaaatcttgcgggtatcttctgcaccgaggccgacgaaggtaccggcgctgcgaccgccgtgcaggaggcaggaaagacaggcacggtgaagattgtctcgttcgatacagacaaggcgacgctgaacgcgatcaagagcggacaaatcactgccactgtcgcgcagggcacatggaacatgggcttctggggcctcatggatttgtttgcgttacatcacaaccttgtgcatcctgtcgccaattggcagcagtccggtgttgatcccgtaccgcctgaagtggatactggcgtgacgatcgtgacgaagagcaacgtgaatgcgtacttgcaacaataa

SEQ ID NO: 698 - protein, 353 aa, Alicyclobacillus acidocaldarius
MTKPSWSTHLACTRKLLWGENMQPVDTAPVNIDKERETWLRRVARIRELTIVLVIVALCIILSFMSSSFLSVDNIVTTILSIVMTAIVSVGMTVALVSGGFDLSVGSVMSMAGVVTGSLALNGVNIWLAAIFGLLASLCSGLITGLFIGKVKINPFIMTLGMQGVVQGVAYVVTQGAPLSVTGVPKSFLYLGQGNLLGIPVLIWILAVVVVVSDFIMRRAVVARKVYYIGSNEAAAYLSGIRVSKVKVWIYIFTALLAGIAGILTLSRFSVAAPTAGQGMELQAIAACIIGGASLTGGEGTVLGALLGSVLVGIVNDALVLLNVSVYWQSLVTGFVLIAAVTLDVLTHRKKAN

SEQ ID NO: 699 - DNA, 1062 bp, Alicyclobacillus acidocaldarius
atgacgaaaccatcatggagtacgcatctggcttgcacaaggaaactgctgtggggtgagaacatgcaaccagtggacaccgctcccgtcaatatcgacaaagaacgcgagacgtggcttcggagagtcgcgcgtattcgagaacttactattgtcctcgtgatcgtggctctctgcatcattctgtccttcatgtcgtcgtcatttctgagtgttgataacatcgtcacgacgattttgagcatcgtcatgacagccattgtatcggtgggcatgacagtggcactcgtgtccggagggttcgacctctcggtcggctccgtgatgtccatggcaggtgtggtcacgggaagcttggcattaaatggtgtgaacatttggctggcggcgatctttggtctgttggccagcctgtgctccgggctgattacaggtctatttatcggcaaggtcaagatcaatccgttcatcatgaccctcggtatgcagggcgtggttcaaggtgtggcttacgtcgtgacccagggtgcgccgttgtccgtcacgggtgtaccgaagtcgtttctctaccttggtcagggcaatttgctgggcattcccgttctcatctggattctggcggtcgtggttgttgtctccgacttcatcatgaggcgtgcagtcgttgctcgtaaggtgtactacatcggcagcaacgaagcggctgcgtacttgtctggtattcgagtctccaaggtaaaggtttggatctacattttcaccgctctattggcgggcatcgcgggaattctgacactctcgcggttcagcgtagctgcaccgaccgctgggcagggtatggaacttcaggccattgctgcgtgtatcatcggcggtgccagcttgacgggaggtgagggtaccgtcctcggagcactgctcggtagcgtgctcgtgggcatcgtaaatgatgcgttggtgctgttgaacgtatccgtttattggcagagccttgttacaggcttcgttctgattgctgcggtgacgttagacgtcctgacccacaggaaaaaggcaaattga

SEQ ID NO: 700 - protein, 281 aa, Caldicellulosiruptor saccharolyticus DSM 8903
ENLITTALGLAADGILAIGMTIVLVSGGVDLSVGSVLGLSAVIAGGLYLSFGVNIWIGSLIALIVCALIGLFNGYFIARVGIPPLIVTLAMMGIARGAAYVLTQGSPLALYGNLKGFDFLGQGKILGIPFFIVFFIFLIILFDFLMRKSAPFRLVYYVGSNENAAKLSGINVPNVKISVYVLMSVLAGIAGIFTLSRFSVAAPTAGNGSELNAISACVIGGASLAGGEGTVLGAILGTILVGIINNALVLLNVSVYWQNLVSGLILIAAVTIDYLTHQKKS

SEQ ID NO: 701 - protein, 279 aa, Clostridium thermocellum ATCC 27405
NNMRSIALSVSVDGLFAIGLTMALILGGIELSVGSVAAMTCVITGYLALQGVNIWVACIASIASGLVVGLFNGFMISKIGLPPFIVTLGMENLARGMAYIITTGSPLSVSGYLPQSFRFFATGSVFGIPVLFIIFIIISAIAFIFMKYSKICRNIYYVGSNENAARLSGINVDRVKIGVYVTIALISTLAGLLSLARFNVATPELSKGAETTAISAAVIGGTSMTGGSGGVLGTVLGIFLLKIVNSALVMMNVSVYWQEFVQGAILVLAVTIDYLSHRK

SEQ ID NO: 702 - protein, 327 aa, Sinorhizobium medicae WSM419
VDILPVAHDARRPAWKRIGTMREAGLIAIILSLCVIMSFASPHFLTLGNFRAMLMSFSVEGIVVVGMTILLIVGGIDLSVGSVVCFSMVLSGSLFLMGVDPWTASLVGIAASAAIGCIMGFFVTVVGLNHFITSLAAMVIVRGLCLVITKGTPLSLFTLPPAFKAVGQGTFFGVPYVIVIFIAVVAVFDFLLRRATAFRKVFYTGSNEKAALYSGIKTKDVKFWVTVLCTTLSGVAGTIYMARFGAATPTFGVGMELNIIAAAVIGGASLNGGSGTILGAILGIALLSVVTSSLILLDVSVYWQDMIKGCILLAAVSIDHMLHKRKA

SEQ ID NO: 703 - protein, 327 aa, Sinorhizobium meliloti 1021
VDTLAVAQKTRRPTWKRIGTMREAGLIAIILSLSVIMSFASPHFLTLGNFRAMLMSFSVEGIVVVGMTILLIVGGIDLSVGSVVCFSMVLSGSLFLMGVDPWTASLVGIAASAAIGCIMGFFVTVVGLNHFITSLAAMVIVRGLCLVITKGTPLSLFTLPPAFKAVGQGTFFGVPYVILIFIAVVGAFDFLLRRATAFRKVFYTGSNEKAALYSGIKTKDVKFWVTVLCATLSGVAGTIYMSRFGAATPTFGVGMELNIIAAAVIGGASLNGGSGTILGAILGIALLSVVTSSLILLDVSVYWQDMIKGCILLAAVSIDHLLNKRKA

SEQ ID NO: 704 - protein, 317 aa, Rhizobium etli CFN 42
RTSSFKRIATMREAGLIAIILALGIVMSFASPHFLTLGNFRAMLMSFSVEGIVVVGMTILLIVGGIDLAVGSVVCFAMVLSGSLFLAGLDPWTASLAGILASSAIGAIMGFFVTVVGLNHFITSLAGMVIVRGLCLIITKGTPLSLFTLPAGFKAVGQGTFYGIPYVILIFVAVVMLFDFLLRRATAFRKVFYTGSNEKAALYSGIKTNQVKFWVTVLCSTLAGVAGVIYMSRFGAATPTFGVGMELNIIAAAVIGGASLNGGSGTILGAILGIALLSLVTSSLILLNVSVYWQDMIKGCILLAAVSIDHFLHKRKA

SEQ ID NO: 705 - protein, 353 aa, Artificial
  Substituion in SEQ ID NO 698
MTKPSWSTHLACTRKLLWGENMQPVDTAPVNIDKERETWLRRVARIRELTIVLVIVALCIILSFMSSSFLSVDNIVTTILSIVMTAIVSVGMTVALVSGGFDLSVGSVMSMAGVVTGSLALNGVNIWLAAIFGLLASLCSGLITGLFIGKVKINPFIMTLGMQGVVQGVAYVVTQGAPLSVTGVPKSFLYLGQGNLLGIPVLIWILAVVVVVSEFIMRRAVVARKVYYIGSNEAAAYLSGIRVSKVKVWIYIFTALLAGIAGILTLSRFSVAAPTAGQGMELQAIAACIIGGASLTGGEGTVLGALLGSVLVGIVNDALVLLNVSVYWQSLVTGFVLIAAVTLDVLTHRKKAN

SEQ ID NO: 706 - protein, 353 aa, Artificial
  Substituion in SEQ ID NO 698
MTKPSWSTHLACTRKLLWGENMQPVDTAPVNIDKERETWLRRVARIRELTIVLVIVALCIILSFMSSSFLSVDNIVTTILSIVMTAIVSVGMTVALVSGGFDLSVGSVMSMAGVVTGSLALNGVNIWLAAIFGLLASLCSGLITGLFIGKIKINPFIMTLGMQGVVQGVAYVVTQGAPLSVTGVPKSFLYLGQGNLLGIPVLIWILAVVVVVSDFIMRRAVVARKVYYIGSNEAAAYLSGIRVSKVKVWIYIFTALLAGIAGILTLSRFSVAAPTAGQGMELQAIAACIIGGASLTGGEGTVLGALLGSVLVGIVNDALVLLNVSVYWQSLVTGFVLIAAVTLDVLTHRKKAN

SEQ ID NO: 707 - protein, 353 aa, Artificial
  Substituion in SEQ ID NO 698
MTKPSWSTHLACTRKLLWGENMQPVDTAPVNIDKERETWLRRVARIRELTIVLVIVALCIILSFMSSSFLSVDNIVTTILSIVMTAIVSVGMTVALVSGGFDLSVGSVMSMAGVVTGSLALNGVNIWLAAIFGLLASLCSGLITGLFIGKVKINPFIMTLGMQGVVQGVAYVVTQGAPLSVTGVPKSFLYLGQGNLLGIPVLIWILAVVVVVSDFIMRRAVVARKVYYIGSNEAAAYLSGIRVSKVKVWIYIFTALLAGIAGIITLSRFSVAAPTAGQGMELQAIAACIIGGASLTGGEGTVLGALLGSVLVGIVNDALVLLNVSVYWQSLVTGFVLIAAVTLDVLTHRKKAN

SEQ ID NO: 708 - protein, 353 aa, Artificial
  Substituion in SEQ ID NO 698
MTKPSWSTHLACTRKLLWGENMQPVDTAPVNIDKERETWLRRVARIRELTIVLVIVALCIILSFMSSSFLSVDNIVTTILSIVMTAIVSVGMTVALVSGGFDLSVGSVMSMAGVVTGSLALNGVNIWLAAIFGLLASLCSGLITGLFIGKVKINPFIMTLGMQGVVQGVAYVVTQGAPLSVTGVPKSFLYLGQGNLLGIPVLIWILAVVVVVSDFIMRRAVVARKVYYLGSNEAAAYLSGIRVSKVKVWIYIFTALLAGIAGILTLSRFSVAAPTAGQGMELQAIAACIIGGASLTGGEGTVLGALLGSVLVGIVNDALVLLNVSVYWQSLVTGFVLIAAVTLDVLTHRKKAN

SEQ ID NO: 709 - protein, 353 aa, Artificial
  Substituion in SEQ ID NO 698
MTKPSWSTHLACTRKLLWGENMQPVDTAPVNIDKERETWLRRVARIRELTIVLVIVALCIILSFMSSSFLSVDNIVTTILSIVMTAIVSVGMTVALVSGGFDLSVGSVMSMAGVVTGSLALNGVNIWLAAIFGLLASLCSGLITGLFIGKVKINPFIMTLGMNGVVQGVAYVVTQGAPLSVTGVPKSFLYLGQGNLLGIPVLIWILAVVVVVSDFIMRRAVVARKVYYIGSNEAAAYLSGIRVSKVKVWIYIFTALLAGIAGILTLSRFSVAAPTAGQGMELQAIAACIIGGASLTGGEGTVLGALLGSVLVGIVNDALVLLNVSVYWQSLVTGFVLIAAVTLDVLTHRKKAN

SEQ ID NO: 710 - DNA, 1062 bp, Artificial
  Substituion in SEQ ID NO 699
atgacgaaaccatcatggagtacgcatctggcttgcacaaggaaactgctgtggggtgagaacatgcaaccagtggacaccgctcccgtcaatatcgacaaagaacgcgagacgtggcttcggagagtcgcgcgtattcgagaacttactattgtcctcgtgatcgtggctctctgcatcattctgtccttcatgtcgtcgtcatttctgagtgttgataacatcgtcacgacgattttgagcatcgtcatgacagccattgtatcggtgggcatgacagtggcactcgtgtccggagggttcgacctctcggtcggctccgtgatgtccatggcaggtgtggtcacgggaagcttggcattaaatggtgtgaacatttggctggcggcgatctttggtctgttggccagcctgtgctccgggctgattacaggtctatttatcggcaaggtcaagatcaatccgttcatcatgaccctcggtatgcagggcgtggttcaaggtgtggcttacgtcgtgacccagggtgcgccgttgtccgtcacgggtgtaccgaagtcgtttctctaccttggtcagggcaatttgctgggcattcccgttctcatctggattctggcggtcgtggttgttgtctccgaattcatcatgaggcgtgcagtcgttgctcgtaaggtgtactacatcggcagcaacgaagcggctgcgtacttgtctggtattcgagtctccaaggtaaaggtttggatctacattttcaccgctctattggcgggcatcgcgggaattctgacactctcgcggttcagcgtagctgcaccgaccgctgggcagggtatggaacttcaggccattgctgcgtgtatcatcggcggtgccagcttgacgggaggtgagggtaccgtcctcggagcactgctcggtagcgtgctcgtgggcatcgtaaatgatgcgttggtgctgttgaacgtatccgtttattggcagagccttgttacaggcttcgttctgattgctgcggtgacgttagacgtcctgacccacaggaaaaaggcaaattga

SEQ ID NO: 711 - DNA, 1062 bp, Artificial
  Substituion in SEQ ID NO 699
atgacgaaaccatcatggagtacgcatctggcttgcacaaggaaactgctgtggggtgagaacatgcaaccagtggacaccgctcccgtcaatatcgacaaagaacgcgagacgtggcttcggagagtcgcgcgtattcgagaacttactattgtcctcgtgatcgtggctctctgcatcattctgtccttcatgtcgtcgtcatttctgagtgttgataacatcgtcacgacgattttgagcatcgtcatgacagccattgtatcggtgggcatgacagtggcactcgtgtccggagggttcgacctctcggtcggctccgtgatgtccatggcaggtgtggtcacgggaagcttggcattaaatggtgtgaacatttggctggcggcgatctttggtctgttggccagcctgtgctccgggctgattacaggtctatttatcggcaagattaagatcaatccgttcatcatgaccctcggtatgcagggcgtggttcaaggtgtggcttacgtcgtgacccagggtgcgccgttgtccgtcacgggtgtaccgaagtcgtttctctaccttggtcagggcaatttgctgggcattcccgttctcatctggattctggcggtcgtggttgttgtctccgacttcatcatgaggcgtgcagtcgttgctcgtaaggtgtactacatcggcagcaacgaagcggctgcgtacttgtctggtattcgagtctccaaggtaaaggtttggatctacattttcaccgctctattggcgggcatcgcgggaattctgacactctcgcggttcagcgtagctgcaccgaccgctgggcagggtatggaacttcaggccattgctgcgtgtatcatcggcggtgccagcttgacgggaggtgagggtaccgtcctcggagcactgctcggtagcgtgctcgtgggcatcgtaaatgatgcgttggtgctgttgaacgtatccgtttattggcagagccttgttacaggcttcgttctgattgctgcggtgacgttagacgtcctgacccacaggaaaaaggcaaattga

SEQ ID NO: 712 - DNA, 1062 bp, Artificial
  Substituion in SEQ ID NO 699
atgacgaaaccatcatggagtacgcatctggcttgcacaaggaaactgctgtggggtgagaacatgcaaccagtggacaccgctcccgtcaatatcgacaaagaacgcgagacgtggcttcggagagtcgcgcgtattcgagaacttactattgtcctcgtgatcgtggctctctgcatcattctgtccttcatgtcgtcgtcatttctgagtgttgataacatcgtcacgacgattttgagcatcgtcatgacagccattgtatcggtgggcatgacagtggcactcgtgtccggagggttcgacctctcggtcggctccgtgatgtccatggcaggtgtggtcacgggaagcttggcattaaatggtgtgaacatttggctggcggcgatctttggtctgttggccagcctgtgctccgggctgattacaggtctatttatcggcaaggtcaagatcaatccgttcatcatgaccctcggtatgcagggcgtggttcaaggtgtggcttacgtcgtgacccagggtgcgccgttgtccgtcacgggtgtaccgaagtcgtttctctaccttggtcagggcaatttgctgggcattcccgttctcatctggattctggcggtcgtggttgttgtctccgacttcatcatgaggcgtgcagtcgttgctcgtaaggtgtactacatcggcagcaacgaagcggctgcgtacttgtctggtattcgagtctccaaggtaaaggtttggatctacattttcaccgctctattggcgggcatcgcgggaattattacactctcgcggttcagcgtagctgcaccgaccgctgggcagggtatggaacttcaggccattgctgcgtgtatcatcggcggtgccagcttgacgggaggtgagggtaccgtcctcggagcactgctcggtagcgtgctcgtgggcatcgtaaatgatgcgttggtgctgttgaacgtatccgtttattggcagagccttgttacaggcttcgttctgattgctgcggtgacgttagacgtcctgacccacaggaaaaaggcaaattga

SEQ ID NO: 713 - DNA, 1062 bp, Artificial
  Substituion in SEQ ID NO 699
atgacgaaaccatcatggagtacgcatctggcttgcacaaggaaactgctgtggggtgagaacatgcaaccagtggacaccgctcccgtcaatatcgacaaagaacgcgagacgtggcttcggagagtcgcgcgtattcgagaacttactattgtcctcgtgatcgtggctctctgcatcattctgtccttcatgtcgtcgtcatttctgagtgttgataacatcgtcacgacgattttgagcatcgtcatgacagccattgtatcggtgggcatgacagtggcactcgtgtccggagggttcgacctctcggtcggctccgtgatgtccatggcaggtgtggtcacgggaagcttggcattaaatggtgtgaacatttggctggcggcgatctttggtctgttggccagcctgtgctccgggctgattacaggtctatttatcggcaaggtcaagatcaatccgttcatcatgaccctcggtatgcagggcgtggttcaaggtgtggcttacgtcgtgacccagggtgcgccgttgtccgtcacgggtgtaccgaagtcgtttctctaccttggtcagggcaatttgctgggcattcccgttctcatctggattctggcggtcgtggttgttgtctccgacttcatcatgaggcgtgcagtcgttgctcgtaaggtgtactacttaggcagcaacgaagcggctgcgtacttgtctggtattcgagtctccaaggtaaaggtttggatctacattttcaccgctctattggcgggcatcgcgggaattctgacactctcgcggttcagcgtagctgcaccgaccgctgggcagggtatggaacttcaggccattgctgcgtgtatcatcggcggtgccagcttgacgggaggtgagggtaccgtcctcggagcactgctcggtagcgtgctcgtgggcatcgtaaatgatgcgttggtgctgttgaacgtatccgtttattggcagagccttgttacaggcttcgttctgattgctgcggtgacgttagacgtcctgacccacaggaaaaaggcaaattga

SEQ ID NO: 714 - DNA, 1062 bp, Artificial
  Substituion in SEQ ID NO 699
atgacgaaaccatcatggagtacgcatctggcttgcacaaggaaactgctgtggggtgagaacatgcaaccagtggacaccgctcccgtcaatatcgacaaagaacgcgagacgtggcttcggagagtcgcgcgtattcgagaacttactattgtcctcgtgatcgtggctctctgcatcattctgtccttcatgtcgtcgtcatttctgagtgttgataacatcgtcacgacgattttgagcatcgtcatgacagccattgtatcggtgggcatgacagtggcactcgtgtccggagggttcgacctctcggtcggctccgtgatgtccatggcaggtgtggtcacgggaagcttggcattaaatggtgtgaacatttggctggcggcgatctttggtctgttggccagcctgtgctccgggctgattacaggtctatttatcggcaaggtcaagatcaatccgttcatcatgaccctcggtatgaatggcgtggttcaaggtgtggcttacgtcgtgacccagggtgcgccgttgtccgtcacgggtgtaccgaagtcgtttctctaccttggtcagggcaatttgctgggcattcccgttctcatctggattctggcggtcgtggttgttgtctccgacttcatcatgaggcgtgcagtcgttgctcgtaaggtgtactacatcggcagcaacgaagcggctgcgtacttgtctggtattcgagtctccaaggtaaaggtttggatctacattttcaccgctctattggcgggcatcgcgggaattctgacactctcgcggttcagcgtagctgcaccgaccgctgggcagggtatggaacttcaggccattgctgcgtgtatcatcggcggtgccagcttgacgggaggtgagggtaccgtcctcggagcactgctcggtagcgtgctcgtgggcatcgtaaatgatgcgttggtgctgttgaacgtatccgtttattggcagagccttgttacaggcttcgttctgattgctgcggtgacgttagacgtcctgacccacaggaaaaaggcaaattga

SEQ ID NO: 715 - protein, 370 aa, Alicyclobacillus acidocaldarius
MAKKTWKKSATWMAAAAVVTGIVAGCGTSSANGQGSTSTGAASAVNPHPSVKIAFLMPETNTSPRWEYDDRPDFIAAMKKLDPNAQIIYANAQGSEATQLQQVESAITEGAKLLVVAPVNGFAATTIVTEAAKAHVPVISYDRLIQNAKVDYYVSFNNVEVGKLQGEYIAQHTKKGGTVVMLDGAPTDPNAKQFAQGAHDVLDPLFKSGKLKLGYEQFTPNWDSQQALTEMQQALTRLHNHVDAVLAANDNLAGAAIQALEQQHIKGIPVTGQDATDAGLHRIYYEGTQSMTVYKPIKEEANAAAQLAYDLITGKKPPASLVNGTVNNGATNVPSVLLQPIVVTKSNVASTVIKDGFTTWARIKNPAEQQ

SEQ ID NO: 716 - DNA, 1113 bp, Alicyclobacillus acidocaldarius
gtggccaagaagacatggaagaagagcgcaacgtggatggcggcggcggccgtcgtgacggggattgtcgctgggtgcggcacctcttcggcgaatgggcagggctcgacgtcgacgggcgcggcgtctgcagtgaatccgcacccgagcgtcaaaatcgcgtttctgatgccggagacgaacacgtcgccgcgttgggagtacgatgatcgcccggacttcatcgcggcgatgaagaagctggatccgaacgcgcagatcatctatgccaacgcgcaggggtctgaggcgacgcagcttcagcaggtggaaagcgccatcacggagggtgcgaagctcctcgtcgtggcaccggtgaacgggtttgcggccacgaccatcgtcaccgaggccgcgaaagcgcacgttcccgtgatctcgtacgatcgcctcattcagaacgccaaggtcgactattacgtctcgttcaacaacgtcgaggtcggcaagcttcagggcgagtacatcgcgcagcacaccaagaagggcggcaccgtggtcatgttggacggcgcgcccacggatccgaacgcgaagcagttcgcgcagggcgcccatgacgtcctggatccgctctttaaatcgggcaagctgaagctcggttatgagcagttcacgccgaactgggattcgcagcaggcgctgaccgagatgcagcaggcgctcacgcggctgcacaatcacgtggacgccgtgctggctgcgaacgacaacctggcgggcgcggccatccaggcgcttgagcagcagcacatcaagggcatccccgtgacaggccaggatgcgaccgacgccggcctgcaccggatttattacgaaggcacccagtcgatgacggtgtacaagcccatcaaggaagaggccaacgcagcggctcagctggcgtatgacctcatcacgggcaagaagccgccggcatcgctcgtgaatggcacggtgaacaacggtgccacgaacgtgccgtccgtgctcctgcagcccatcgttgtgacgaagtcgaacgtcgcaagcacggtcatcaaggacggcttcacgacctgggcgcgcatcaagaacccggcagagcagcagtaa

SEQ ID NO: 717 - protein, 341 aa, Acidiphilium cryptum JF-5
GLTAAHAQSVTQPSVHQISSKKTTIAFLLPENSSPRYEQVDRPWFIKMAHAADPNAKLIVSNANSSPDTQLNQAESAISNGADVLVVDPVDGKAGAAIVNYAARNHVKVISYDRLIQDSKPDYYVSFDNTKVGELQGEYIAKHTKPGGSVMMINGAPTDPNAFDFRKGAMNVLGPLFKSGKLHLAYSVMTPDWSPQNAFEESQQALTRLHNKVNAVLAANDGTASGVIRALQAVGLAGKVPVTGQDATNGGLTFILEGLQSMTVFKYVPEEAAAAAELAVAVATDTKPPAGLLNGKTNNKMIDVPSVLLKPLVVTKANIAGSVIKSGYTTWKAICVGPAAQ

SEQ ID NO: 718 - protein, 324 aa, Herpetosiphon aurantiacus ATCC 23779
TAPTTGTGGTTSSGGKVVALFLPDAKTARYETADRPYFEAKMKELCPDCQVIYNNANQDASLQLQQAEAALTNGAKVLVLDPVDSAAAASIADKAKAQNVPVIAYDRLILNSDGVSYYISFDNESVGKLQAESLVAQLDKQGIANPTIVMINGSPTDNNAKLFKAGAHSVFDPLVSAGKLTIANEYDTPDWSPDKAQDQMQQALTSMGNKVDGVYAANDGTGGGAIAAMKAGGLSPLPPVTGQDAELAAIQRILAGDQYMTVYKAIKPQAEAAAELAFALLEGKTSDKATSKVNNGKIDVPSILLTPIAVTKENVKDTIVKDQF

SEQ ID NO: 719 - protein, 305 aa, Stigmatella aurantiaca DW4/3-1
KIALLLPESKTSRYESHDRPHFERKVKELCPDCEVIYSNADQDASKQQSQTEAALTNGAQVLVLDPVDSASAAAMVARARQSKVPVISYDRLITNSDVDYYISFDNEKVGKLQGQALLDKLKADGKDKGTIVIINGAPTDNNAKLFKAGAHSILDGSGLVVGAEYDTPDWSPDKAQQQMEQAVTSLGKDKIVGVYAANDGTAGGAIAAMKAAGVNPLPPVTGQDAELAGIQRVLVGEQYMTVYKAIKPEAEAAAELAVALLRGQVPEGKVNAKVNNGQKDVPSILLPPVSVTKENVKSTIVADGF

SEQ ID NO: 720 - protein, 302 aa, Frankia sp. EAN1pec
IALLLPETQTTRYESADRPYFEARMAKICPDCKVLYSNADQDSAAQQNQAEQAMTNGAKVLVLDPVDGEAAAVIARNARDRGVRVVSYDRLIQKAPVDAYISFDNEKVGQLQGQALLDAIGDRAGAGKVIMINGSQDDPNAQQFKDGALSVLEGKVTIGFDTFTPDWSPDTAGREMDQAITTVGRENIVGVYAANDGMAGAVVAALRRANVNPLPPVTGQDAELAGVQRVLAGDQHMTVYKAIRPEAEQAADLALALLRGEPVDTIATGHVDNGNGQVPAVLLEPVAVTRDTVAATVVKDGF

SEQ ID NO: 721 - protein, 321 aa, Moorella thermoacetica ATCC 39073
GQGGNSSKNGGNQGASAKNGDKIKIGLSMDDLRQERWQHDRDLFVAKAKELGAEVLVQSANGDDATQLSQAENLISQGINVLVVIPHNGDAMAPIVEAAHKAGVKVLAYDRLIRNADVDLYISFDNVRVGELQAEYLTKKVPKGKYFLMGGSPTDNNAKLFRQGQMNVLKPLIDKGDIKVVGDQWVKDWLPEEAMKIMENALTSNNNQIDAVVASNDSTAGGAIQALAAQNLAGKVAISGQDADLAACQRIVEGTQSMTVYKPITTLATRAAEVAVALAKGENIGANNKVNNGKIDVPSVLLTPIMVDKDNMVQTVIKDGF

SEQ ID NO: 722 - protein, 370 aa, Artificial
  Substituion in SEQ ID NO 715
MAKKTWKKSATWMAAAAVVTGIVAGCGTSSANGQGSTSTGAASAVNPHPSVKIAFLMPETNTSPRWEYDDRPDFIAAMKKLDPNAQIIYANAQGSEATQLQQVESAITEGAKLLVVAPVNGFAATTIVTEAAKAHVPVISYDRLIQNAKVDYYVSFNNVEVGKLQGEYIAQHTKKGGTVVMLDGAPTDPNAKQFAQGAHDVLDPLFKSGKLKLGYEQFTPNWDSQQALTEMQQALTRLHNHVDAVLAANDNLAGAAIQALEQQHIKGIPVTGQDATDAGLHRIYYEGTQSMTVYKPIKEEANAAAQLAYDLITGKKPPASLVQGTVNNGATNVPSVLLQPIVVTKSNVASTVIKDGFTTWARIKNPAEQQ

SEQ ID NO: 723 - protein, 370 aa, Artificial
  Substituion in SEQ ID NO 715
MAKKTWKKSATWMAAAAVVTGIVAGCGTSSANGQGSTSTGAASAVNPHPSVKIAFLMPETNTSPRWEYDDRPDFIAAMKKLDPNAQIIYANAQGSEATQLQQVESAITEGAKLLVVAPVNGFAATTIVTEAAKAHVPVISYDRLIQNAKVDYYVSFNNVEVGKLQGEYIAQHTRKGGTVVMLDGAPTDPNAKQFAQGAHDVLDPLFKSGKLKLGYEQFTPNWDSQQALTEMQQALTRLHNHVDAVLAANDNLAGAAIQALEQQHIKGIPVTGQDATDAGLHRIYYEGTQSMTVYKPIKEEANAAAQLAYDLITGKKPPASLVNGTVNNGATNVPSVLLQPIVVTKSNVASTVIKDGFTTWARIKNPAEQQ

SEQ ID NO: 724 - protein, 370 aa, Artificial
  Substituion in SEQ ID NO 715
MAKKTWKKSATWMAAAAVVTGIVAGCGTSSANGQGSTSTGAASAVNPHPSVKIAFLMPETNTSPRWEYDDRPDFIAAMKKLDPNAQIIYANAQGSEATQLQQVESAITEGAKLLVVAPVNGFAATTIVTEAAKAHVPVISYDRLIQNAKVDYYVSFNNVEVGKLQGEYIAQHTKKGGTVVMLDGAPTDPNAKQFAQGAHDVLDPLFKSGKLKLGYEQFTPNWDSQQALTEMQQALTRLHNHVDAVLAANDNLAGAAIQALEQQHLKGIPVTGQDATDAGLHRIYYEGTQSMTVYKPIKEEANAAAQLAYDLITGKKPPASLVNGTVNNGATNVPSVLLQPIVVTKSNVASTVIKDGFTTWARIKNPAEQQ

SEQ ID NO: 725 - protein, 370 aa, Artificial
  Substituion in SEQ ID NO 715
MAKKTWKKSATWMAAAAVVTGIVAGCGTSSANGQGSTSTGAASAVNPHPSVKIAFLMPETNTSPRWEYDDRPDFIAAMKKLDPNAQIIYANAQGSEATQLQQVESAITEGAKLLVVAPVNGFAATTIVTEAAKAHVPVISYDRLIQNAKVDYYVSFNNVEVGKLQGEYIAQHTKKGGTVVMLDGAPTDPNAKQFAQGAHDVLDPLFKSGKLKLGYEQFTPNWDSQQALTEMQQALTRLHNHVDAVLAANDNLAGAAIQALEQQHIKGIPVTGQDATDAGLHRIYYEGTQSMTVYKPIKEEANAAAQLAYDLLTGKKPPASLVNGTVNNGATNVPSVLLQPIVVTKSNVASTVIKDGFTTWARIKNPAEQQ

SEQ ID NO: 726 - protein, 370 aa, Artificial
  Substituion in SEQ ID NO 715
MAKKTWKKSATWMAAAAVVTGIVAGCGTSSANGQGSTSTGAASAVNPHPSVKIAFLMPETNTSPRWEYDDRPEFIAAMKKLDPNAQIIYANAQGSEATQLQQVESAITEGAKLLVVAPVNGFAATTIVTEAAKAHVPVISYDRLIQNAKVDYYVSFNNVEVGKLQGEYIAQHTKKGGTVVMLDGAPTDPNAKQFAQGAHDVLDPLFKSGKLKLGYEQFTPNWDSQQALTEMQQALTRLHNHVDAVLAANDNLAGAAIQALEQQHIKGIPVTGQDATDAGLHRIYYEGTQSMTVYKPIKEEANAAAQLAYDLITGKKPPASLVNGTVNNGATNVPSVLLQPIVVTKSNVASTVIKDGFTTWARIKNPAEQQ

SEQ ID NO: 727 - DNA, 1113 bp, Artificial
  Substituion in SEQ ID NO 716
gtggccaagaagacatggaagaagagcgcaacgtggatggcggcggcggccgtcgtgacggggattgtcgctgggtgcggcacctcttcggcgaatgggcagggctcgacgtcgacgggcgcggcgtctgcagtgaatccgcacccgagcgtcaaaatcgcgtttctgatgccggagacgaacacgtcgccgcgttgggagtacgatgatcgcccggacttcatcgcggcgatgaagaagctggatccgaacgcgcagatcatctatgccaacgcgcaggggtctgaggcgacgcagcttcagcaggtggaaagcgccatcacggagggtgcgaagctcctcgtcgtggcaccggtgaacgggtttgcggccacgaccatcgtcaccgaggccgcgaaagcgcacgttcccgtgatctcgtacgatcgcctcattcagaacgccaaggtcgactattacgtctcgttcaacaacgtcgaggtcggcaagcttcagggcgagtacatcgcgcagcacaccaagaagggcggcaccgtggtcatgttggacggcgcgcccacggatccgaacgcgaagcagttcgcgcagggcgcccatgacgtcctggatccgctctttaaatcgggcaagctgaagctcggttatgagcagttcacgccgaactgggattcgcagcaggcgctgaccgagatgcagcaggcgctcacgcggctgcacaatcacgtggacgccgtgctggctgcgaacgacaacctggcgggcgcggccatccaggcgcttgagcagcagcacatcaagggcatccccgtgacaggccaggatgcgaccgacgccggcctgcaccggatttattacgaaggcacccagtcgatgacggtgtacaagcccatcaaggaagaggccaacgcagcggctcagctggcgtatgacctcatcacgggcaagaagccgccggcatcgctcgtgcaaggcacggtgaacaacggtgccacgaacgtgccgtccgtgctcctgcagcccatcgttgtgacgaagtcgaacgtcgcaagcacggtcatcaaggacggcttcacgacctgggcgcgcatcaagaacccggcagagcagcagtaa

SEQ ID NO: 728 - DNA, 1113 bp, Artificial
  Substituion in SEQ ID NO 716
gtggccaagaagacatggaagaagagcgcaacgtggatggcggcggcggccgtcgtgacggggattgtcgctgggtgcggcacctcttcggcgaatgggcagggctcgacgtcgacgggcgcggcgtctgcagtgaatccgcacccgagcgtcaaaatcgcgtttctgatgccggagacgaacacgtcgccgcgttgggagtacgatgatcgcccggacttcatcgcggcgatgaagaagctggatccgaacgcgcagatcatctatgccaacgcgcaggggtctgaggcgacgcagcttcagcaggtggaaagcgccatcacggagggtgcgaagctcctcgtcgtggcaccggtgaacgggtttgcggccacgaccatcgtcaccgaggccgcgaaagcgcacgttcccgtgatctcgtacgatcgcctcattcagaacgccaaggtcgactattacgtctcgttcaacaacgtcgaggtcggcaagcttcagggcgagtacatcgcgcagcacacccgtaagggcggcaccgtggtcatgttggacggcgcgcccacggatccgaacgcgaagcagttcgcgcagggcgcccatgacgtcctggatccgctctttaaatcgggcaagctgaagctcggttatgagcagttcacgccgaactgggattcgcagcaggcgctgaccgagatgcagcaggcgctcacgcggctgcacaatcacgtggacgccgtgctggctgcgaacgacaacctggcgggcgcggccatccaggcgcttgagcagcagcacatcaagggcatccccgtgacaggccaggatgcgaccgacgccggcctgcaccggatttattacgaaggcacccagtcgatgacggtgtacaagcccatcaaggaagaggccaacgcagcggctcagctggcgtatgacctcatcacgggcaagaagccgccggcatcgctcgtgaatggcacggtgaacaacggtgccacgaacgtgccgtccgtgctcctgcagcccatcgttgtgacgaagtcgaacgtcgcaagcacggtcatcaaggacggcttcacgacctgggcgcgcatcaagaacccggcagagcagcagtaa

SEQ ID NO: 729 - DNA, 1113 bp, Artificial
  Substituion in SEQ ID NO 716
gtggccaagaagacatggaagaagagcgcaacgtggatggcggcggcggccgtcgtgacggggattgtcgctgggtgcggcacctcttcggcgaatgggcagggctcgacgtcgacgggcgcggcgtctgcagtgaatccgcacccgagcgtcaaaatcgcgtttctgatgccggagacgaacacgtcgccgcgttgggagtacgatgatcgcccggacttcatcgcggcgatgaagaagctggatccgaacgcgcagatcatctatgccaacgcgcaggggtctgaggcgacgcagcttcagcaggtggaaagcgccatcacggagggtgcgaagctcctcgtcgtggcaccggtgaacgggtttgcggccacgaccatcgtcaccgaggccgcgaaagcgcacgttcccgtgatctcgtacgatcgcctcattcagaacgccaaggtcgactattacgtctcgttcaacaacgtcgaggtcggcaagcttcagggcgagtacatcgcgcagcacaccaagaagggcggcaccgtggtcatgttggacggcgcgcccacggatccgaacgcgaagcagttcgcgcagggcgcccatgacgtcctggatccgctctttaaatcgggcaagctgaagctcggttatgagcagttcacgccgaactgggattcgcagcaggcgctgaccgagatgcagcaggcgctcacgcggctgcacaatcacgtggacgccgtgctggctgcgaacgacaacctggcgggcgcggccatccaggcgcttgagcagcagcacttaaagggcatccccgtgacaggccaggatgcgaccgacgccggcctgcaccggatttattacgaaggcacccagtcgatgacggtgtacaagcccatcaaggaagaggccaacgcagcggctcagctggcgtatgacctcatcacgggcaagaagccgccggcatcgctcgtgaatggcacggtgaacaacggtgccacgaacgtgccgtccgtgctcctgcagcccatcgttgtgacgaagtcgaacgtcgcaagcacggtcatcaaggacggcttcacgacctgggcgcgcatcaagaacccggcagagcagcagtaa

SEQ ID NO: 730 - DNA, 1113 bp, Artificial
  Substituion in SEQ ID NO 716
gtggccaagaagacatggaagaagagcgcaacgtggatggcggcggcggccgtcgtgacggggattgtcgctgggtgcggcacctcttcggcgaatgggcagggctcgacgtcgacgggcgcggcgtctgcagtgaatccgcacccgagcgtcaaaatcgcgtttctgatgccggagacgaacacgtcgccgcgttgggagtacgatgatcgcccggacttcatcgcggcgatgaagaagctggatccgaacgcgcagatcatctatgccaacgcgcaggggtctgaggcgacgcagcttcagcaggtggaaagcgccatcacggagggtgcgaagctcctcgtcgtggcaccggtgaacgggtttgcggccacgaccatcgtcaccgaggccgcgaaagcgcacgttcccgtgatctcgtacgatcgcctcattcagaacgccaaggtcgactattacgtctcgttcaacaacgtcgaggtcggcaagcttcagggcgagtacatcgcgcagcacaccaagaagggcggcaccgtggtcatgttggacggcgcgcccacggatccgaacgcgaagcagttcgcgcagggcgcccatgacgtcctggatccgctctttaaatcgggcaagctgaagctcggttatgagcagttcacgccgaactgggattcgcagcaggcgctgaccgagatgcagcaggcgctcacgcggctgcacaatcacgtggacgccgtgctggctgcgaacgacaacctggcgggcgcggccatccaggcgcttgagcagcagcacatcaagggcatccccgtgacaggccaggatgcgaccgacgccggcctgcaccggatttattacgaaggcacccagtcgatgacggtgtacaagcccatcaaggaagaggccaacgcagcggctcagctggcgtatgacctcttaacgggcaagaagccgccggcatcgctcgtgaatggcacggtgaacaacggtgccacgaacgtgccgtccgtgctcctgcagcccatcgttgtgacgaagtcgaacgtcgcaagcacggtcatcaaggacggcttcacgacctgggcgcgcatcaagaacccggcagagcagcagtaa

SEQ ID NO: 731 - DNA, 1113 bp, Artificial
  Substituion in SEQ ID NO 716
gtggccaagaagacatggaagaagagcgcaacgtggatggcggcggcggccgtcgtgacggggattgtcgctgggtgcggcacctcttcggcgaatgggcagggctcgacgtcgacgggcgcggcgtctgcagtgaatccgcacccgagcgtcaaaatcgcgtttctgatgccggagacgaacacgtcgccgcgttgggagtacgatgatcgcccggaattcatcgcggcgatgaagaagctggatccgaacgcgcagatcatctatgccaacgcgcaggggtctgaggcgacgcagcttcagcaggtggaaagcgccatcacggagggtgcgaagctcctcgtcgtggcaccggtgaacgggtttgcggccacgaccatcgtcaccgaggccgcgaaagcgcacgttcccgtgatctcgtacgatcgcctcattcagaacgccaaggtcgactattacgtctcgttcaacaacgtcgaggtcggcaagcttcagggcgagtacatcgcgcagcacaccaagaagggcggcaccgtggtcatgttggacggcgcgcccacggatccgaacgcgaagcagttcgcgcagggcgcccatgacgtcctggatccgctctttaaatcgggcaagctgaagctcggttatgagcagttcacgccgaactgggattcgcagcaggcgctgaccgagatgcagcaggcgctcacgcggctgcacaatcacgtggacgccgtgctggctgcgaacgacaacctggcgggcgcggccatccaggcgcttgagcagcagcacatcaagggcatccccgtgacaggccaggatgcgaccgacgccggcctgcaccggatttattacgaaggcacccagtcgatgacggtgtacaagcccatcaaggaagaggccaacgcagcggctcagctggcgtatgacctcatcacgggcaagaagccgccggcatcgctcgtgaatggcacggtgaacaacggtgccacgaacgtgccgtccgtgctcctgcagcccatcgttgtgacgaagtcgaacgtcgcaagcacggtcatcaaggacggcttcacgacctgggcgcgcatcaagaacccggcagagcagcagtaa

SEQ ID NO: 732 - protein, 260 aa, Alicyclobacillus acidocaldarius
MATEVKTQPVLEVRSLRKRFGAVQALDGVSFSVHAGEIVALVGDNGAGKSTTIKMIAGVEQPDEGEILFEGQPVRLTSPAVAEKYGIQTVYQDLALCDNLDIVSNLFLGRELRRSVIPGLVRVIDRNEMERRAIPVLNELGIRLPPLHTQVASLSGGQRQTVAVARSVLWGSKLVMLDEPTAALGVVQQRAVLELIQRLAASGRAVLVISHNMSDVFKIANRIVVLRLGRTVATFDREQVTPEQVVAAITGASAQEEVTS

SEQ ID NO: 733 - DNA, 783 bp, Alicyclobacillus acidocaldarius
gtggcaacggaggtcaagacacagccggtcctcgaggtgcgcagccttcgcaagcgatttggcgccgttcaggcgttggacggtgtttcgttttccgtgcatgcaggcgaaatcgtggcgctcgtcggggacaacggcgccggtaagtcgaccaccatcaagatgatcgcgggtgtcgagcagccggacgaaggagagatcttgttcgagggccagccggtccgcctgacgagtccagccgtggcagaaaagtacggcattcagacggtctaccaggacctcgcgctctgtgacaacctggacatcgtctcgaacctgtttctcggccgggagctgcggcgcagcgtgattcccgggctggtgcgcgtgatcgaccggaacgagatggagcggcgcgccatccctgtgctgaacgaacttgggattcgcctgcccccattgcacacgcaggtcgcatcgctctccggtggtcaacgccagacggtcgctgtggcgcgatccgtcctgtggggttcgaaactcgtcatgctcgatgagccgaccgctgcgctcggcgtcgtgcagcagcgcgcggtgcttgagctcatccagaggcttgcagcgagcggccgcgcggtgctcgtcatctcgcacaacatgagcgacgtgtttaaaattgccaaccgcatcgtggtgctgcggttggggcgaaccgtggcgacgttcgatcgggagcaagtcacgcccgagcaggttgtggcggccatcacgggcgcatcggcgcaagaggaggtcacgtcctaa

SEQ ID NO: 734 - protein, 250 aa, Herpetosiphon aurantiacus ATCC 23779
ATEAAMPVLQLRQISKRFGAVQALSNVDFEVYSNEVVALVGDNGAGKSTLIKTIAGAYKPDEGDYVFEGKVVSINSPRDATDLGVETVYQDLALCDNLDVVSNLYLGRENVRRSGLKSFDLLNETEMERRATEVLRDLSVKIPSVRVQIANLSGGQRQSVAVARSVMWNSKVVLLDEPTAALGVEQTRQVKDLIMRLRDRGLAVVVISHNVADVFEVSDRIIVMRLGRRVATFHTARSTNEQVIGAITGA

SEQ ID NO: 735 - protein, 255 aa, Plectonema boryanum
ASSSSTRPTLELRNICKSFGGVQALKNVDFEVYAGEVVGLVGDNGAGKSTLVKTMSGAYVPDSGEIFLNGERVSIASPQDATRLGIETVYQDLALCDNLDVVGNLWLGREAYRWLIPGVLKVLDETEMERRTIEVLKLLDVKIPSVRRPVAALSGGQRQCIAVAKTILRSPKVVLLDEPTAALGVAQTRQVLNLIQRLKQQGLAVVVISHNLHDVFEVCDRVIVMRLGQRSATFDIQSSTSEQVVAAITGAEYRD

SEQ ID NO: 736 - protein, 254 aa, Acidiphilium cryptum JF-5
IAAEPAAAPLLEVRGLQKRYGAVVALRDVNFTVRRGEVTALLGDNGAGKSTTIKAIAGVAPIDEGEILLEGRPVSIRHPSEATALGIQTVYQDLALCDNLGICANLYLGRELVSTPTALGPHVLRDVDMELEARRVLKTLRINLPALDTPVASLSGGQRQAVAIARAVLWDSKLVIMDEPTAALGVAQTAEVLRLVRDLAEQGYGVILITHNMQNVFQVADNIAVLRLGATVMEARKSDVTPEQVVGAITGTLA

SEQ ID NO: 737 - protein, 240 aa, Thermobifida fusca YX
QPILELSGISKRFGAVQALSDVDLTVHAGEVVALLGDNGAGKSTLVKVIAGVNPADSGTILWEGKPVQINRPSDAQQLGIATIYQDLALCDNLDIVANLFLGTERTALGVLDELEMERRAHELLDSLSVRIPNLRIPVAALSGGQRQIIAIARSLLGDPKVVMLDEPTAALGVAQTAQVLDLIERLRDQGLGVILISHNMADVRAVADRAVVLRLGRNAGDFRIEDTSYEEIVAAITGAA

SEQ ID NO: 738 - protein, 243 aa, Streptomyces avermitilis MA-4680
VSATPVLALRGVSKRFGAVQALTDVELEIHAGEVVALVGDNGAGKSTLVKTIAGVHPIDEGVIEWDGKAVQINKPHDAQNLGIATVYQDLALCDNIDVVGNLYLGRELRKRGILDEVEMERRSRELLTTLSIRIPSVRIPIASLSGGQRQTVAIARSMLGEPKLVILDEPTAALGVEQTAQVLDLVERLRERGHAVILISHNMADVKAVADKVAVLRLGRNNGVFEVKSTSQEEIISAITGAT

SEQ ID NO: 739 - protein, 260 aa, Artificial
  Substituion in SEQ ID NO 732
MATEVRTQPVLEVRSLRKRFGAVQALDGVSFSVHAGEIVALVGDNGAGKSTTIKMIAGVEQPDEGEILFEGQPVRLTSPAVAEKYGIQTVYQDLALCDNLDIVSNLFLGRELRRSVIPGLVRVIDRNEMERRAIPVLNELGIRLPPLHTQVASLSGGQRQTVAVARSVLWGSKLVMLDEPTAALGVVQQRAVLELIQRLAASGRAVLVISHNMSDVFKIANRIVVLRLGRTVATFDREQVTPEQVVAAITGASAQEEVTS

SEQ ID NO: 740 - protein, 260 aa, Artificial
  Substituion in SEQ ID NO 732
MATEVKTQPVLEVRSLRKRFGAVQALDGVSFSVHAGEIVALVGDNGAGKSTTIKMIAGVEQPDEGEILFEGQPVRLTSPAVAEKYGIQTVYQDLALCDNLDIVSNLFLGRELRRSVLPGLVRVIDRNEMERRAIPVLNELGIRLPPLHTQVASLSGGQRQTVAVARSVLWGSKLVMLDEPTAALGVVQQRAVLELIQRLAASGRAVLVISHNMSDVFKIANRIVVLRLGRTVATFDREQVTPEQVVAAITGASAQEEVTS

SEQ ID NO: 741 - protein, 260 aa, Artificial
  Substituion in SEQ ID NO 732
MATEVKTQPVLEVRSLRKRFGAVQALDGVSFSVHAGEIVALVGDNGAGKSTTIKMIAGVEQPDEGEILFEGNPVRLTSPAVAEKYGIQTVYQDLALCDNLDIVSNLFLGRELRRSVIPGLVRVIDRNEMERRAIPVLNELGIRLPPLHTQVASLSGGQRQTVAVARSVLWGSKLVMLDEPTAALGVVQQRAVLELIQRLAASGRAVLVISHNMSDVFKIANRIVVLRLGRTVATFDREQVTPEQVVAAITGASAQEEVTS

SEQ ID NO: 742 - protein, 260 aa, Artificial
  Substituion in SEQ ID NO 732
MATEVKTQPVLEVRSLRKRFGAVQALDGVSFSVHAGEIIALVGDNGAGKSTTIKMIAGVEQPDEGEILFEGQPVRLTSPAVAEKYGIQTVYQDLALCDNLDIVSNLFLGRELRRSVIPGLVRVIDRNEMERRAIPVLNELGIRLPPLHTQVASLSGGQRQTVAVARSVLWGSKLVMLDEPTAALGVVQQRAVLELIQRLAASGRAVLVISHNMSDVFKIANRIVVLRLGRTVATFDREQVTPEQVVAAITGASAQEEVTS

SEQ ID NO: 743 - protein, 260 aa, Artificial
  Substituion in SEQ ID NO 732
MATEVKTQPVLEVRSLRKRFGAVQALDGVSFSVHAGEIVALVGDNGAGKSTTIKMIAGVEQPDEGEILFEGQPVRLTSPAVAEKYGIQTVYQDLALCDNLDIVSNLFLGRELRRSVIPGLVRVIDRNEMERRAIPVLNELGIRLPPLHTQVASLSGGQRQTVAVARSVLWGSKLVMLDEPTAALGVVQQRAVLELLQRLAASGRAVLVISHNMSDVFKIANRIVVLRLGRTVATFDREQVTPEQVVAAITGASAQEEVTS

SEQ ID NO: 744 - DNA, 783 bp, Artificial
  Substituion in SEQ ID NO 733
gtggcaacggaggtccgtacacagccggtcctcgaggtgcgcagccttcgcaagcgatttggcgccgttcaggcgttggacggtgtttcgttttccgtgcatgcaggcgaaatcgtggcgctcgtcggggacaacggcgccggtaagtcgaccaccatcaagatgatcgcgggtgtcgagcagccggacgaaggagagatcttgttcgagggccagccggtccgcctgacgagtccagccgtggcagaaaagtacggcattcagacggtctaccaggacctcgcgctctgtgacaacctggacatcgtctcgaacctgtttctcggccgggagctgcggcgcagcgtgattcccgggctggtgcgcgtgatcgaccggaacgagatggagcggcgcgccatccctgtgctgaacgaacttgggattcgcctgcccccattgcacacgcaggtcgcatcgctctccggtggtcaacgccagacggtcgctgtggcgcgatccgtcctgtggggttcgaaactcgtcatgctcgatgagccgaccgctgcgctcggcgtcgtgcagcagcgcgcggtgcttgagctcatccagaggcttgcagcgagcggccgcgcggtgctcgtcatctcgcacaacatgagcgacgtgtttaaaattgccaaccgcatcgtggtgctgcggttggggcgaaccgtggcgacgttcgatcgggagcaagtcacgcccgagcaggttgtggcggccatcacgggcgcatcggcgcaagaggaggtcacgtcctaa

SEQ ID NO: 745 - DNA, 783 bp, Artificial
  Substituion in SEQ ID NO 733
gtggcaacggaggtcaagacacagccggtcctcgaggtgcgcagccttcgcaagcgatttggcgccgttcaggcgttggacggtgtttcgttttccgtgcatgcaggcgaaatcgtggcgctcgtcggggacaacggcgccggtaagtcgaccaccatcaagatgatcgcgggtgtcgagcagccggacgaaggagagatcttgttcgagggccagccggtccgcctgacgagtccagccgtggcagaaaagtacggcattcagacggtctaccaggacctcgcgctctgtgacaacctggacatcgtctcgaacctgtttctcggccgggagctgcggcgcagcgtgttacccgggctggtgcgcgtgatcgaccggaacgagatggagcggcgcgccatccctgtgctgaacgaacttgggattcgcctgcccccattgcacacgcaggtcgcatcgctctccggtggtcaacgccagacggtcgctgtggcgcgatccgtcctgtggggttcgaaactcgtcatgctcgatgagccgaccgctgcgctcggcgtcgtgcagcagcgcgcggtgcttgagctcatccagaggcttgcagcgagcggccgcgcggtgctcgtcatctcgcacaacatgagcgacgtgtttaaaattgccaaccgcatcgtggtgctgcggttggggcgaaccgtggcgacgttcgatcgggagcaagtcacgcccgagcaggttgtggcggccatcacgggcgcatcggcgcaagaggaggtcacgtcctaa

SEQ ID NO: 746 - DNA, 783 bp, Artificial
  Substituion in SEQ ID NO 733
gtggcaacggaggtcaagacacagccggtcctcgaggtgcgcagccttcgcaagcgatttggcgccgttcaggcgttggacggtgtttcgttttccgtgcatgcaggcgaaatcgtggcgctcgtcggggacaacggcgccggtaagtcgaccaccatcaagatgatcgcgggtgtcgagcagccggacgaaggagagatcttgttcgagggcaatccggtccgcctgacgagtccagccgtggcagaaaagtacggcattcagacggtctaccaggacctcgcgctctgtgacaacctggacatcgtctcgaacctgtttctcggccgggagctgcggcgcagcgtgattcccgggctggtgcgcgtgatcgaccggaacgagatggagcggcgcgccatccctgtgctgaacgaacttgggattcgcctgcccccattgcacacgcaggtcgcatcgctctccggtggtcaacgccagacggtcgctgtggcgcgatccgtcctgtggggttcgaaactcgtcatgctcgatgagccgaccgctgcgctcggcgtcgtgcagcagcgcgcggtgcttgagctcatccagaggcttgcagcgagcggccgcgcggtgctcgtcatctcgcacaacatgagcgacgtgtttaaaattgccaaccgcatcgtggtgctgcggttggggcgaaccgtggcgacgttcgatcgggagcaagtcacgcccgagcaggttgtggcggccatcacgggcgcatcggcgcaagaggaggtcacgtcctaa

SEQ ID NO: 747 - DNA, 783 bp, Artificial
  Substituion in SEQ ID NO 733
gtggcaacggaggtcaagacacagccggtcctcgaggtgcgcagccttcgcaagcgatttggcgccgttcaggcgttggacggtgtttcgttttccgtgcatgcaggcgaaatcattgcgctcgtcggggacaacggcgccggtaagtcgaccaccatcaagatgatcgcgggtgtcgagcagccggacgaaggagagatcttgttcgagggccagccggtccgcctgacgagtccagccgtggcagaaaagtacggcattcagacggtctaccaggacctcgcgctctgtgacaacctggacatcgtctcgaacctgtttctcggccgggagctgcggcgcagcgtgattcccgggctggtgcgcgtgatcgaccggaacgagatggagcggcgcgccatccctgtgctgaacgaacttgggattcgcctgcccccattgcacacgcaggtcgcatcgctctccggtggtcaacgccagacggtcgctgtggcgcgatccgtcctgtggggttcgaaactcgtcatgctcgatgagccgaccgctgcgctcggcgtcgtgcagcagcgcgcggtgcttgagctcatccagaggcttgcagcgagcggccgcgcggtgctcgtcatctcgcacaacatgagcgacgtgtttaaaattgccaaccgcatcgtggtgctgcggttggggcgaaccgtggcgacgttcgatcgggagcaagtcacgcccgagcaggttgtggcggccatcacgggcgcatcggcgcaagaggaggtcacgtcctaa

SEQ ID NO: 748 - DNA, 783 bp, Artificial
  Substituion in SEQ ID NO 733
gtggcaacggaggtcaagacacagccggtcctcgaggtgcgcagccttcgcaagcgatttggcgccgttcaggcgttggacggtgtttcgttttccgtgcatgcaggcgaaatcgtggcgctcgtcggggacaacggcgccggtaagtcgaccaccatcaagatgatcgcgggtgtcgagcagccggacgaaggagagatcttgttcgagggccagccggtccgcctgacgagtccagccgtggcagaaaagtacggcattcagacggtctaccaggacctcgcgctctgtgacaacctggacatcgtctcgaacctgtttctcggccgggagctgcggcgcagcgtgattcccgggctggtgcgcgtgatcgaccggaacgagatggagcggcgcgccatccctgtgctgaacgaacttgggattcgcctgcccccattgcacacgcaggtcgcatcgctctccggtggtcaacgccagacggtcgctgtggcgcgatccgtcctgtggggttcgaaactcgtcatgctcgatgagccgaccgctgcgctcggcgtcgtgcagcagcgcgcggtgcttgagctcttacagaggcttgcagcgagcggccgcgcggtgctcgtcatctcgcacaacatgagcgacgtgtttaaaattgccaaccgcatcgtggtgctgcggttggggcgaaccgtggcgacgttcgatcgggagcaagtcacgcccgagcaggttgtggcggccatcacgggcgcatcggcgcaagaggaggtcacgtcctaa

SEQ ID NO: 749 - protein, 401 aa, Alicyclobacillus acidocaldarius
MTVNIGQAKQTQTPAARSTSVFDRIIGGEFQQLPVFLSLVLIWIVFEILNNSFLTSRNLSNLVLQMAEYGLLGVGETLILLLGEIDLSIAAVSAIGGAILAVLAGNGVNPYVAILAGALSGTVLGLFQGFWVTVLRVPSFIVTLAGSLAFLGLLFVLIGQEGTVPIMNNTINAIAGNYLPDWLSWVLVAVALLLMVWTAVRDRAKRQKLGLPPKSAVSTWTKLILSAAVMIGATVLLNAYQGVPIAGLVLIVFVVLLAWICQSTAFGRHIYAVGGNAEAARRAGINVKGVRIMVFTLAGTMAAIGGIVGASRLGAASTASGGSDLLMDSIAAAVIGGTSLFGGYGSVWNALLGALVIGSIENGMALLNAPTSTKYLVEGAILLLAVTFDTFTRMRRKQLGR

SEQ ID NO: 750 - DNA, 1206 bp, Alicyclobacillus acidocaldarius
atgacagtcaacatcggtcaggccaagcagacgcagacgcccgcggcgcgcagcacctcggtgttcgatcgcatcattggcggggagtttcaacagctgccggtgtttttgtcgctggtcctcatctggattgtgtttgagatcttgaacaacagctttctcacgagccgcaacctgtcgaacctcgtgctgcagatggcggaatacggcctcctcggggtcggcgagacgctcattctcctgctcggggagattgacttgtccatcgcggccgtgagcgccatcggcggcgcgattctcgcggtgttggcgggcaatggtgtaaatccgtatgtggcgattctcgccggcgccttgagcggcacggtgctcgggttgttccaaggcttttgggtgacggtgcttcgcgtgccgtcgtttatcgtgacgctggccggatcgctcgcttttttgggtctgttgtttgtcctcatcggccaggagggcacggtgcccatcatgaacaacaccatcaatgccatcgcgggtaactacctgcccgattggctgagttgggtgttggtggccgtggctttgctcctcatggtgtggacagcggtgcgcgatcgcgccaagcggcagaagcttgggctgcccccgaaatctgcggtgtcgacgtggacgaagctcatcctgagcgccgcggtgatgattggcgcgacggtgctgctcaacgcctatcagggcgtgcccatcgcggggctggtgctgattgtgtttgtggtgctgctcgcgtggatctgtcagagcaccgcgtttggccgccacatctatgcggtgggcggcaatgcggaagccgcgcgccgggccggtatcaacgtgaagggcgtgcggatcatggtgttcacgctcgcgggcaccatggcggccatcggcggcatcgtcggcgcgtccaggctgggtgcggcgtccacggcgtccggcggcagcgatttgctcatggactcgattgcggcggccgtgatcggcggcacgagcctgttcggcggctatgggagcgtgtggaacgcgcttctcggcgcgctcgtcatcggcagcatcgagaacggcatggcgctgttgaacgcgccgaccagcacgaagtatctggtggaaggcgccatcttgttgctcgcggtcacgttcgacacgttcacccgcatgcggcggaagcagttgggtagatga

SEQ ID NO: 751 - protein, 390 aa, Herpetosiphon aurantiacus ATCC 23779
ERFRQGNLGSLPVIIGLIIIALVFQSINKNFLTPLNLTNLMVQIAAMGTISTGVVLILLLGEVDLSAGQVSGLAAAVMAVLVSRHNLPAAVAIIGAIVVGALVGLLQGWWISTFRVPSFVVTLAGLLAWQGSRLRVLGDTGSINITNKFINDIANYKLPIWLGWVLGIVSVVVYTLIVFNEYRSRRAAELPTGSLNGVFWRVGVVGASVLAGVAMMSVNRNANAAGNPIQGVPSAVIIFLTFLIIFDFITQRTRFGRYVYAVGGNTEAARRAGINVNRIRITIFMLASALAACGGILAASRLNAANQSSGDGDVLLNAIAAAVIGGTSLFGGRGRIWSALLGALVIGAIANGMDLLALKSSIKFIVTGSVLLLAVTIDAASRARRENSGR

SEQ ID NO: 752 - protein, 378 aa, Stigmatella aurantiaca DW4/3-1
RLSQGELGSLPVIIGLCVIWLIFYIANDRFLSAVNLTNLMLQITAMGTISAGIVLVLLLGDIDLSAGAVSGLSAAVMALNVKMGYGAVPSLLAGLATGAAIGAFHGLWMTRFRVPPFVVTLAGLLGWQGAQLFVLGNTGTVNLNDSFIIGLAGTFFEPAIAWLVVALIVVVHVATVFVERRRREAAGLPLVPLRSTVVRMVFTHGALVAAVAVFTQDRGLPLAALIFGGVVLLLELLIRHTRFGRHTFAVGGNAEAARRAGIRVDRIRVTIFTLASTMAAAGGILAASRLLAVNQSSGSGDVLLNAIAAAVIGGTSLFGGRGSAWSALLGALVIGSISNGMDLLALSSSVKFMVTGAVLLVAASIDALSRRGRQAAGR

SEQ ID NO: 753 - protein, 383 aa, Frankia sp. EAN1pec
SALRHVRAGELGSLPVIVGLVVIWTIFQFQNSNFLTSYNLTNLALQVAATGTIATGVFLVLLLGEIDLSVGWVSGLCASVMAVLSVRHGWAPVLAIVAALVVGVAVGALQGSLFAVFGVPSFVVTLAGFIAWQGVQLKVLGRDGSLNLPDSEITKLTSTFFTDATGWVIAGIAVAGYAGAQLAEVRGRRRAGLRPRPIAEVAVRVVVVGGALIAAVAILNDDRGLPLALLIFGCLVLLVDLVSRRTSYGRHLYAVGGNVEAARRAGINVRALRVSAFAAASCLAGVGGVLAAARLTSVTQASGGSDTLLNAIAAAVIGGTSLFGGRGRAWSALLGILVIGSIANGMDLLGLDQSVKFIITGSVLLAAVLLDAAARRGRQASGR

SEQ ID NO: 754 - protein, 369 aa, Acidiphilium cryptum JF-5
LPVIAALIVIWIVFETLNANFLTPRNLSNLAAQIVVTGTLALAEIYIILLGMIDLSIGWNSVLAASVFSLATVFFHLPVGVGIVLGIALATGLGFLQGMVVSRIGVPSFVVTLGGGMIAEGLTLAILTPHGGSVPLADNFTTAIGTLNLDPLWSWVLSLLLFGAYAAVTLNGIRKRTASGHEGGFAATMRLVGVAIMLFGAVFMLNAYRGVPFLLMIFLIALFASAFVTKSTRFGRHLYAVGGNAEAARRAGISVKGIQLAVFIIAGFLVGLAGYLDAARLGVASASVGNGDIMLNAVAAAVIGGTSLFGGRGSVYGALFGALVIASVSNGMNLLGAASSVRFIVEGLILLAAITIDTILRLRRMRSGR

SEQ ID NO: 755 - protein, 380 aa, Thermobifida fusca YX
RLRSGELGPLPVLVGLIVIAGVFWSLNPKFLTAQNLSNLTLQIVAVGFMACGVIMVLLLGEIDLSVGSVAGVCGVIVTLLAVNYQWNEIAAIVVAILAGTLIGTLHGTIFAKIGVPAFVVTLAGLIGWQGAQLYLLGPEGTINVPYNGLIGAITHTYLVPAVGWGIGITAVALYGLISVRGARRRAAAGLPAKSVTEIGVRTALLALPVLGGVWVLNSFRGVPVAFLLFVGVVVLFDLILRKTRYGRMVFAVGGSAEAARRAGINVDLIRISVFALASTLAGVGGILLVSRSYAVNQLTGGGDDLMMAIAAAVIGGTSLFGGRGSAYSALLGGLVLGAISSGLYLLQMDSSVRFMITAVVLLVAVILDAVSRRTRKAHAR

SEQ ID NO: 756 - protein, 401 aa, Artificial
  Substituion in SEQ ID NO 749
MTVNIGQAKQTQTPAARSTSVFDRIIGGEFQQLPVFLSLVLIWIVFEILNNSFLTSRNLSNLVLQMAEYGLLGVGETLILLLGEIDLSIAAVSAIGGAILAVLAGNGVNPYVAILAGALSGTVLGLFQGFWVTVLRVPSFIVTLAGSLAFLGLLFVLIGQEGTVPIMNNTINAIAGNYLPDWLSWVLVAVALLLMVWTAVKDRAKRQKLGLPPKSAVSTWTKLILSAAVMIGATVLLNAYQGVPIAGLVLIVFVVLLAWICQSTAFGRHIYAVGGNAEAARRAGINVKGVRIMVFTLAGTMAAIGGIVGASRLGAASTASGGSDLLMDSIAAAVIGGTSLFGGYGSVWNALLGALVIGSIENGMALLNAPTSTKYLVEGAILLLAVTFDTFTRMRRKQLGR

SEQ ID NO: 757 - protein, 401 aa, Artificial
  Substituion in SEQ ID NO 749
MTVNIGQAKQTQTPAARSTSVFDRIIGGEFQQLPVFLSLVLIWIVFEILNNSFLTSRNLSNLVLQMAEYGLLGVGETLILLLGEIDLSIAAISAIGGAILAVLAGNGVNPYVAILAGALSGTVLGLFQGFWVTVLRVPSFIVTLAGSLAFLGLLFVLIGQEGTVPIMNNTINAIAGNYLPDWLSWVLVAVALLLMVWTAVRDRAKRQKLGLPPKSAVSTWTKLILSAAVMIGATVLLNAYQGVPIAGLVLIVFVVLLAWICQSTAFGRHIYAVGGNAEAARRAGINVKGVRIMVFTLAGTMAAIGGIVGASRLGAASTASGGSDLLMDSIAAAVIGGTSLFGGYGSVWNALLGALVIGSIENGMALLNAPTSTKYLVEGAILLLAVTFDTFTRMRRKQLGR

SEQ ID NO: 758 - protein, 401 aa, Artificial
  Substituion in SEQ ID NO 749
MTVNIGQAKQTQTPAARSTSVFDRIIGGEFQQLPVFLSLVLIWIVFEILNNSFLTSRNLSNLVLQMAEYGLLGVGETIILLLGEIDLSIAAVSAIGGAILAVLAGNGVNPYVAILAGALSGTVLGLFQGFWVTVLRVPSFIVTLAGSLAFLGLLFVLIGQEGTVPIMNNTINAIAGNYLPDWLSWVLVAVALLLMVWTAVRDRAKRQKLGLPPKSAVSTWTKLILSAAVMIGATVLLNAYQGVPIAGLVLIVFVVLLAWICQSTAFGRHIYAVGGNAEAARRAGINVKGVRIMVFTLAGTMAAIGGIVGASRLGAASTASGGSDLLMDSIAAAVIGGTSLFGGYGSVWNALLGALVIGSIENGMALLNAPTSTKYLVEGAILLLAVTFDTFTRMRRKQLGR

SEQ ID NO: 759 - protein, 401 aa, Artificial
  Substituion in SEQ ID NO 749
MTVNIGQAKQTQTPAARSTSVFDRIIGGEFQQLPVFLSLVLIWIVFEILNNSFLTSKNLSNLVLQMAEYGLLGVGETLILLLGEIDLSIAAVSAIGGAILAVLAGNGVNPYVAILAGALSGTVLGLFQGFWVTVLRVPSFIVTLAGSLAFLGLLFVLIGQEGTVPIMNNTINAIAGNYLPDWLSWVLVAVALLLMVWTAVRDRAKRQKLGLPPKSAVSTWTKLILSAAVMIGATVLLNAYQGVPIAGLVLIVFVVLLAWICQSTAFGRHIYAVGGNAEAARRAGINVKGVRIMVFTLAGTMAAIGGIVGASRLGAASTASGGSDLLMDSIAAAVIGGTSLFGGYGSVWNALLGALVIGSIENGMALLNAPTSTKYLVEGAILLLAVTFDTFTRMRRKQLGR

SEQ ID NO: 760 - protein, 401 aa, Artificial
  Substituion in SEQ ID NO 749
MTVNIGQAKQTQTPAARSTSVFDRIIGGEFQQLPVFLSLVLIWIVFEILNNSFLTSRNLSNLVLQMAEYGLLGVGETLILLLGEIDLSIAAVSAIGGAILAVLAGNGVNPYVAILAGALSGTVLGLFQGFWVTVLRVPSFIVTLAGSLAFLGLLFVLIGQEGTVPIMNNTINAIAGNYLPDWLSWVLVAVALLLMVWTAVRDRAKRQKLGLPPKSAVSTWTKLILSAAVMLGATVLLNAYQGVPIAGLVLIVFVVLLAWICQSTAFGRHIYAVGGNAEAARRAGINVKGVRIMVFTLAGTMAAIGGIVGASRLGAASTASGGSDLLMDSIAAAVIGGTSLFGGYGSVWNALLGALVIGSIENGMALLNAPTSTKYLVEGAILLLAVTFDTFTRMRRKQLGR

SEQ ID NO: 761 - DNA, 1206 bp, Artificial
  Substituion in SEQ ID NO 750
atgacagtcaacatcggtcaggccaagcagacgcagacgcccgcggcgcgcagcacctcggtgttcgatcgcatcattggcggggagtttcaacagctgccggtgtttttgtcgctggtcctcatctggattgtgtttgagatcttgaacaacagctttctcacgagccgcaacctgtcgaacctcgtgctgcagatggcggaatacggcctcctcggggtcggcgagacgctcattctcctgctcggggagattgacttgtccatcgcggccgtgagcgccatcggcggcgcgattctcgcggtgttggcgggcaatggtgtaaatccgtatgtggcgattctcgccggcgccttgagcggcacggtgctcgggttgttccaaggcttttgggtgacggtgcttcgcgtgccgtcgtttatcgtgacgctggccggatcgctcgcttttttgggtctgttgtttgtcctcatcggccaggagggcacggtgcccatcatgaacaacaccatcaatgccatcgcgggtaactacctgcccgattggctgagttgggtgttggtggccgtggctttgctcctcatggtgtggacagcggtgaaagatcgcgccaagcggcagaagcttgggctgcccccgaaatctgcggtgtcgacgtggacgaagctcatcctgagcgccgcggtgatgattggcgcgacggtgctgctcaacgcctatcagggcgtgcccatcgcggggctggtgctgattgtgtttgtggtgctgctcgcgtggatctgtcagagcaccgcgtttggccgccacatctatgcggtgggcggcaatgcggaagccgcgcgccgggccggtatcaacgtgaagggcgtgcggatcatggtgttcacgctcgcgggcaccatggcggccatcggcggcatcgtcggcgcgtccaggctgggtgcggcgtccacggcgtccggcggcagcgatttgctcatggactcgattgcggcggccgtgatcggcggcacgagcctgttcggcggctatgggagcgtgtggaacgcgcttctcggcgcgctcgtcatcggcagcatcgagaacggcatggcgctgttgaacgcgccgaccagcacgaagtatctggtggaaggcgccatcttgttgctcgcggtcacgttcgacacgttcacccgcatgcggcggaagcagttgggtagatga

SEQ ID NO: 762 - DNA, 1206 bp, Artificial
  Substituion in SEQ ID NO 750
atgacagtcaacatcggtcaggccaagcagacgcagacgcccgcggcgcgcagcacctcggtgttcgatcgcatcattggcggggagtttcaacagctgccggtgtttttgtcgctggtcctcatctggattgtgtttgagatcttgaacaacagctttctcacgagccgcaacctgtcgaacctcgtgctgcagatggcggaatacggcctcctcggggtcggcgagacgctcattctcctgctcggggagattgacttgtccatcgcggccattagcgccatcggcggcgcgattctcgcggtgttggcgggcaatggtgtaaatccgtatgtggcgattctcgccggcgccttgagcggcacggtgctcgggttgttccaaggcttttgggtgacggtgcttcgcgtgccgtcgtttatcgtgacgctggccggatcgctcgcttttttgggtctgttgtttgtcctcatcggccaggagggcacggtgcccatcatgaacaacaccatcaatgccatcgcgggtaactacctgcccgattggctgagttgggtgttggtggccgtggctttgctcctcatggtgtggacagcggtgcgcgatcgcgccaagcggcagaagcttgggctgcccccgaaatctgcggtgtcgacgtggacgaagctcatcctgagcgccgcggtgatgattggcgcgacggtgctgctcaacgcctatcagggcgtgcccatcgcggggctggtgctgattgtgtttgtggtgctgctcgcgtggatctgtcagagcaccgcgtttggccgccacatctatgcggtgggcggcaatgcggaagccgcgcgccgggccggtatcaacgtgaagggcgtgcggatcatggtgttcacgctcgcgggcaccatggcggccatcggcggcatcgtcggcgcgtccaggctgggtgcggcgtccacggcgtccggcggcagcgatttgctcatggactcgattgcggcggccgtgatcggcggcacgagcctgttcggcggctatgggagcgtgtggaacgcgcttctcggcgcgctcgtcatcggcagcatcgagaacggcatggcgctgttgaacgcgccgaccagcacgaagtatctggtggaaggcgccatcttgttgctcgcggtcacgttcgacacgttcacccgcatgcggcggaagcagttgggtagatga

SEQ ID NO: 763 - DNA, 1206 bp, Artificial
  Substituion in SEQ ID NO 750
atgacagtcaacatcggtcaggccaagcagacgcagacgcccgcggcgcgcagcacctcggtgttcgatcgcatcattggcggggagtttcaacagctgccggtgtttttgtcgctggtcctcatctggattgtgtttgagatcttgaacaacagctttctcacgagccgcaacctgtcgaacctcgtgctgcagatggcggaatacggcctcctcggggtcggcgagacgattattctcctgctcggggagattgacttgtccatcgcggccgtgagcgccatcggcggcgcgattctcgcggtgttggcgggcaatggtgtaaatccgtatgtggcgattctcgccggcgccttgagcggcacggtgctcgggttgttccaaggcttttgggtgacggtgcttcgcgtgccgtcgtttatcgtgacgctggccggatcgctcgcttttttgggtctgttgtttgtcctcatcggccaggagggcacggtgcccatcatgaacaacaccatcaatgccatcgcgggtaactacctgcccgattggctgagttgggtgttggtggccgtggctttgctcctcatggtgtggacagcggtgcgcgatcgcgccaagcggcagaagcttgggctgcccccgaaatctgcggtgtcgacgtggacgaagctcatcctgagcgccgcggtgatgattggcgcgacggtgctgctcaacgcctatcagggcgtgcccatcgcggggctggtgctgattgtgtttgtggtgctgctcgcgtggatctgtcagagcaccgcgtttggccgccacatctatgcggtgggcggcaatgcggaagccgcgcgccgggccggtatcaacgtgaagggcgtgcggatcatggtgttcacgctcgcgggcaccatggcggccatcggcggcatcgtcggcgcgtccaggctgggtgcggcgtccacggcgtccggcggcagcgatttgctcatggactcgattgcggcggccgtgatcggcggcacgagcctgttcggcggctatgggagcgtgtggaacgcgcttctcggcgcgctcgtcatcggcagcatcgagaacggcatggcgctgttgaacgcgccgaccagcacgaagtatctggtggaaggcgccatcttgttgctcgcggtcacgttcgacacgttcacccgcatgcggcggaagcagttgggtagatga

SEQ ID NO: 764 - DNA, 1206 bp, Artificial
  Substituion in SEQ ID NO 750
atgacagtcaacatcggtcaggccaagcagacgcagacgcccgcggcgcgcagcacctcggtgttcgatcgcatcattggcggggagtttcaacagctgccggtgtttttgtcgctggtcctcatctggattgtgtttgagatcttgaacaacagctttctcacgagcaaaaacctgtcgaacctcgtgctgcagatggcggaatacggcctcctcggggtcggcgagacgctcattctcctgctcggggagattgacttgtccatcgcggccgtgagcgccatcggcggcgcgattctcgcggtgttggcgggcaatggtgtaaatccgtatgtggcgattctcgccggcgccttgagcggcacggtgctcgggttgttccaaggcttttgggtgacggtgcttcgcgtgccgtcgtttatcgtgacgctggccggatcgctcgcttttttgggtctgttgtttgtcctcatcggccaggagggcacggtgcccatcatgaacaacaccatcaatgccatcgcgggtaactacctgcccgattggctgagttgggtgttggtggccgtggctttgctcctcatggtgtggacagcggtgcgcgatcgcgccaagcggcagaagcttgggctgcccccgaaatctgcggtgtcgacgtggacgaagctcatcctgagcgccgcggtgatgattggcgcgacggtgctgctcaacgcctatcagggcgtgcccatcgcggggctggtgctgattgtgtttgtggtgctgctcgcgtggatctgtcagagcaccgcgtttggccgccacatctatgcggtgggcggcaatgcggaagccgcgcgccgggccggtatcaacgtgaagggcgtgcggatcatggtgttcacgctcgcgggcaccatggcggccatcggcggcatcgtcggcgcgtccaggctgggtgcggcgtccacggcgtccggcggcagcgatttgctcatggactcgattgcggcggccgtgatcggcggcacgagcctgttcggcggctatgggagcgtgtggaacgcgcttctcggcgcgctcgtcatcggcagcatcgagaacggcatggcgctgttgaacgcgccgaccagcacgaagtatctggtggaaggcgccatcttgttgctcgcggtcacgttcgacacgttcacccgcatgcggcggaagcagttgggtagatga

SEQ ID NO: 765 - DNA, 1206 bp, Artificial
  Substituion in SEQ ID NO 750
atgacagtcaacatcggtcaggccaagcagacgcagacgcccgcggcgcgcagcacctcggtgttcgatcgcatcattggcggggagtttcaacagctgccggtgtttttgtcgctggtcctcatctggattgtgtttgagatcttgaacaacagctttctcacgagccgcaacctgtcgaacctcgtgctgcagatggcggaatacggcctcctcggggtcggcgagacgctcattctcctgctcggggagattgacttgtccatcgcggccgtgagcgccatcggcggcgcgattctcgcggtgttggcgggcaatggtgtaaatccgtatgtggcgattctcgccggcgccttgagcggcacggtgctcgggttgttccaaggcttttgggtgacggtgcttcgcgtgccgtcgtttatcgtgacgctggccggatcgctcgcttttttgggtctgttgtttgtcctcatcggccaggagggcacggtgcccatcatgaacaacaccatcaatgccatcgcgggtaactacctgcccgattggctgagttgggtgttggtggccgtggctttgctcctcatggtgtggacagcggtgcgcgatcgcgccaagcggcagaagcttgggctgcccccgaaatctgcggtgtcgacgtggacgaagctcatcctgagcgccgcggtgatgttaggcgcgacggtgctgctcaacgcctatcagggcgtgcccatcgcggggctggtgctgattgtgtttgtggtgctgctcgcgtggatctgtcagagcaccgcgtttggccgccacatctatgcggtgggcggcaatgcggaagccgcgcgccgggccggtatcaacgtgaagggcgtgcggatcatggtgttcacgctcgcgggcaccatggcggccatcggcggcatcgtcggcgcgtccaggctgggtgcggcgtccacggcgtccggcggcagcgatttgctcatggactcgattgcggcggccgtgatcggcggcacgagcctgttcggcggctatgggagcgtgtggaacgcgcttctcggcgcgctcgtcatcggcagcatcgagaacggcatggcgctgttgaacgcgccgaccagcacgaagtatctggtggaaggcgccatcttgttgctcgcggtcacgttcgacacgttcacccgcatgcggcggaagcagttgggtagatga

SEQ ID NO: 766 - protein, 476 aa, Alicyclobacillus acidocaldarius
MGTGVPVSSAAGILARMERLTAWPLPRRLFLVIGLGYLFTFYDIFDVNVSFVQTATSIIPGATPADASRYIGLPIFANLLGYVVGTLVLSPLADRVGRRRMLMTTMFITGVGSLLTALAMRDWWFILARGITGVGVAADLAVVNTYMSEVAPRRARAKYTSGLFIFSGVGALVGIWLGLWLTTPSAPFPEGLPFALATSSFHWGWRLMYYIGAVLALIALLLRLELPESPRWLAAKGRVEEAAAVVAAMEERLGLGAFQSDGTAASFSLVSDTRAPYGELFGSPVYRRRIFLLFFVWLFSYVTVYGFSAGMTTLLVGAGYAPSEAGLIVAVGVLGMLLAGVVAYLAGEVMERKTYLLVSAVLTILGGLVVGLAGHHLWLSYLGAILLFFGQNVWVPVFYAWTAENFPSRARTSGFALVDGAGHIGAGVGLWAIAPLIPSLGVTAGFVAMSGFLLIAAFIALGGIASRGKVLEEISP

SEQ ID NO: 767 - DNA, 1431 bp, Alicyclobacillus acidocaldarius
atgggcacgggtgtgcctgtttcgagcgcggcgggcatcttggcgcggatggagcggttgaccgcatggccgcttccgcggcgattgttcctcgtcatcggtctcgggtatctgttcaccttctacgacatattcgacgtcaatgtgtcctttgtgcagaccgccacatccatcatacccggtgcaactccggcggacgccagccggtacatcggattgcccatcttcgccaacctgttggggtacgtggtcggcacgcttgtgttgagccctcttgccgatcgcgtcgggcgaaggcgtatgctgatgaccaccatgttcatcacgggggtcggttctctgttgacagctctcgcgatgcgcgactggtggtttattctcgcgcgcggcatcacgggcgtgggcgtggccgcggatctggctgtcgtgaatacctacatgagcgaggtcgcgccgagaagagcgagggcgaagtacacctcaggattgttcattttctcaggtgtcggagcgcttgtgggcatctggctcgggttgtggttgacgacgcccagtgcgccgtttccggaaggacttccgtttgcgcttgcaacttcgtcgttccattggggctggcggttgatgtactacatcggggcggtactcgcgctcatcgcactcctgctgcggcttgagctccctgagtctcctcgctggctggccgcgaaggggcgagtcgaagaagccgccgctgttgtagctgctatggaggagcgcctgggcttgggcgcgtttcaatccgatggaaccgccgcatcgttctcgctggtctccgacacgcgcgcgccgtatggcgaactgtttggcagtcctgtgtatcgcaggcgaatcttcctcctgtttttcgtctggctctttagctatgtgaccgtgtacggattttctgcaggcatgaccacgctgctcgtgggcgcaggctatgcgccgagtgaggcggggctcatcgtggccgtcggcgtcttgggcatgctgctggccggcgtcgtggcgtaccttgcgggagaagtcatggaacgcaaaacctatctgctcgtgtctgcggtcctgaccatcttgggaggactcgtggtggggcttgctggacaccatctgtggctttcgtacctcggtgcaatcctcctcttcttcgggcagaacgtgtgggtgccggtgttttacgcgtggactgcggaaaactttccatctcgcgcgaggaccagcggtttcgccctcgtggatggagcgggacacatcggcgccggagtcggtttgtgggccatcgcgccgttgattccctctctcggcgtgaccgccggatttgtggcgatgtcgggcttccttctgatcgcggcgttcatcgcccttggagggattgcgtctcgaggcaaagttttggaggagatttcgccgtag

SEQ ID NO: 768 - protein, 470 aa, Acidiphilium cryptum JF-5
NTAGLLLARLDRIPNWTLPRLYALVIGIGFLFTFYDIFDINVSFIQTCMALVPGCTPAKSGAYIGLPVLLNLAGYVVGTLVLSPLADRMGRRDLLLVTMILTGIGSALTAIVQSYGTFVAARAFTGVGIGADLAIVNTYIGELAPAGGRARYTSMIFIFSALGAVAGIWLGLWLTTPPTPLPLGLPFALAGKGFPDGWRVMYLIGAALALVGVLLRFQLPESPRWLIAQGRLEEAGQVVADMEARAHAIFPLPPLPERLPPAPRREEAMPFSAIFRNATYRNRTLLLTVMWFLAYITVYSFAAGFTTLLAALHYPPPEAGLITAMGTFGFVLCAIVAYVWGERMERRRWTPLAALITLGGGVLIALGGQTLWLSVIGAMIVFFGFNVWVPIAYAWSVENYPTRARTTGFALVDGIGHLGGGVGMIAIAPLIPRLGVMAAFLLIGGFLALAALVAQFGISTRARRLDDISP

SEQ ID NO: 769 - protein, 445 aa, Sulfolobus solfataricus P2
AGEAIARMDRIPIWGLSYIFIGILGIGFLFTFYDIFDINVSFIQTALTLFHVSNPTSPQIPALLGPIVLLNLVGYIIGALILSPISDVIGRRRMLMITMIITGLGSLYNALANNYVNFLVARTITGIGVGADLAIVNTYIGEVAPINGRARYTSLVFLFSTLGATLGIWLGLFLTTPSAPFPLGLPFALGGSGFFAVNGWRVMYGIGALLALIGLLLRFSLPESPRWLISKGKLTEAERIVEVMEKKATGKLGNLPPLPNIIQPYIAERYSYLDALKTIFSSSLYIKRFGILVSMWLFGYMTVYTLAAGLTSVLASLGFAPPEAGMIAAIGVIGFILVPITTFFVGDRLERKTWTVISVVFTIIGGLLIAIAGTNIALSFLGSIILFYGFNLWVPTSYAWTAESFPTRARSTGFALCDGVGHIGGGIGIIAISSFIGSLIASGVT

SEQ ID NO: 770 - protein, 447 aa, Sulfolobus acidocaldarius DSM 639
AGEIIARMDRIPIWGLSYIFIGILGIGFLFTFYDIFDINVSFIQTAVTIFHVSSPSSPQIPLLLGPAVLLNLIGYVIGSLVLSPVSDIIGRRRMLMITMIITGLGSLYNTFVNDYLNFVMARTITGIGVGADLAIVNTYIGEVAPTNGRAKYTSLVFLFSTLGATLGIWLGLLLTTPPAPFPLGLPFALGLSGFFAVNGWRVMYGIGALLALVGLLLRFSLPESPRWLISRNRISEAEKIVNMMEDKATKKLKQLPSLPKVITPYLSEMLSYADTLKTIFSNSQYVKRFVILFTMWLFGYMTVYTLAAGLTSVLASLGYPPPEAGIIAAMGSIGFILVPLTTFAVGDRLERKVWTAISVIFTFLGGLLIALAGTNVVVSFIGSIILFYGFNLWVPISYAWTAESFPTRARSTGFALCDGIGHVGGGIGLIIIASFISSLLSSGVTTG

SEQ ID NO: 771 - protein, 472 aa, Sulfolobus tokodaii str. 7
TKSSEIIARLDRLPTWAFNYILLGIIGVGELFTFYDIFNINVSFVQTAVTLFHVSPAQAAQLLGPVVLGNLVGYVVGSLVLSPIADRIGRRDMLMITMLIMGLSSLYNAFAPNYINFFIARTLTGIGVGADLAIVNTYISEVAPLAYRSKYVSAIFIFSTVGGFLAIWLGLLFTTPPAPFPQGLPIALGGSGFFAINGWRVMYIIGAVLALIGLALRFRLPESPRWLISKGRVSEAEMIVNLMEEKVTSRGYKLPPLPSLIPIYKASKPVPYSEIFTNSTYLKRFITLVIVWFLAYTTVYSIAAGLTSLLTAQGYSTSEAGMISAIGIIGFILAAVIATLFGDRLERKWWIGIGALVTVIGGMMVALTPNPIIDGLGAIILFIGFNVWVPVAYTWTAESFPTRARTSGFALCDGFGHLGGGLGVVYITSVATTLHSTVELFGLIAGFLVVAAIIAMVTGHYTLGKRLDEISP

SEQ ID NO: 772 - protein, 484 aa, Metallosphaera sedula DSM 5348
NASEIIARLDRLPVWSLPATFIAVLGTGFLFTFFDIFDINVSFIQTALTTFGVSSPSSPEIPQLLGPVVLWNLVGYVIGALALTPLADRYGRKRMLMITMAITGLGSLYNALSPDYLNYLLARTITGIGVGADLAIVNTYINEVSPVNGRAKFTSLVFLFATLGAFLGLWLGLLITTPPAPFPLGLPFALGTTGIFATAGWRIMYGIGSLLALIGLLLRVELPESPRWLASKGRIMEASKIVERMEEAARKKIGELPPVPQHIEVKTITEVSYKEALRTILGNRVYLKRWIIVMSMWFFGYITVYTNAAGLTTILSSLGYPSSEAGMIASLGILGFVAVPVLLILFGDRLERKVWVPISAVIMLLGGAIMAEAGHNFFLEVLGAFVLFFGNNLWIPISYAWTTENFPTRARVTGFGLADGIGHIGGGIGAFLVALQIGNIVSHGVTSNTPLEVFMLMISFQLLSALISLAGIRTAKRRLDEISP

SEQ ID NO: 773 - protein, 476 aa, Artificial
  Substituion in SEQ ID NO 766
MGTGVPVSSAAGILARMERLTAWPLPRRLFLVIGLGYLFTFYDIFDVNVSFVQTATSIIPGATPADASRYIGLPIFANLLGYVIGTLVLSPLADRVGRRRMLMTTMFITGVGSLLTALAMRDWWFILARGITGVGVAADLAVVNTYMSEVAPRRARAKYTSGLFIFSGVGALVGIWLGLWLTTPSAPFPEGLPFALATSSFHWGWRLMYYIGAVLALIALLLRLELPESPRWLAAKGRVEEAAAVVAAMEERLGLGAFQSDGTAASFSLVSDTRAPYGELFGSPVYRRRIFLLFFVWLFSYVTVYGFSAGMTTLLVGAGYAPSEAGLIVAVGVLGMLLAGVVAYLAGEVMERKTYLLVSAVLTILGGLVVGLAGHHLWLSYLGAILLFFGQNVWVPVFYAWTAENFPSRARTSGFALVDGAGHIGAGVGLWAIAPLIPSLGVTAGFVAMSGFLLIAAFIALGGIASRGKVLEEISP

SEQ ID NO: 774 - protein, 476 aa, Artificial
  Substituion in SEQ ID NO 766
MGTGVPVSSAAGILARMERLTAWPLPRRLFLVIGLGYLFTFYDIFDVNVSFVQTATSIIPGATPADASRYIGLPIFANLLGYVVGTLVLSPLADRVGRRRMLMTTMFITGVGSLLTALAMRDWWFILARGITGVGVAADLAVVNTYMSEVAPRRARAKYTSGLFIFSGVGALVGIWLGLWLTTPSAPFPEGLPFALATSSFHWGWRLMYYIGAVLALIALLLRLELPESPRWLAAKGRVEEAAAVVAAMEERLGLGAFQSDGTAASFSLVSDTRAPYGELFGSPVYRRRIFLLFFVWLFSYVTVYGFSAGMTTLLVGAGYAPSEAGLIIAVGVLGMLLAGVVAYLAGEVMERKTYLLVSAVLTILGGLVVGLAGHHLWLSYLGAILLFFGQNVWVPVFYAWTAENFPSRARTSGFALVDGAGHIGAGVGLWAIAPLIPSLGVTAGFVAMSGFLLIAAFIALGGIASRGKVLEEISP

SEQ ID NO: 775 - protein, 476 aa, Artificial
  Substituion in SEQ ID NO 766
MGTGVPVSSAAGILARMERLTAWPLPRRLFLVIGLGYLFTFYDIFDVNVSFVQTATSIIPGATPADASRYIGLPIFANLLGYVVGTLVLSPLADRVGRRRMLMTTMFITGVGSLLTALAMRDWWFILARGITGVGVAADLAVVNTYMSEVAPRRARAKYTSGLFIFSGVGALVGIWLGLWLTTPSAPFPEGLPFALATSSFHWGWRLMYYIGAVLALIALLLRLELPESPRWLAAKGRVEEAAAVVAAMEERLGLGAFQSDGTAASFSLVSDTKAPYGELFGSPVYRRRIFLLFFVWLFSYVTVYGFSAGMTTLLVGAGYAPSEAGLIVAVGVLGMLLAGVVAYLAGEVMERKTYLLVSAVLTILGGLVVGLAGHHLWLSYLGAILLFFGQNVWVPVFYAWTAENFPSRARTSGFALVDGAGHIGAGVGLWAIAPLIPSLGVTAGFVAMSGFLLIAAFIALGGIASRGKVLEEISP

SEQ ID NO: 776 - protein, 476 aa, Artificial
  Substituion in SEQ ID NO 766
MGTGVPVSSAAGILARMERLTAWPLPRRLFLVIGLGYLFTFYDIFDVNVSFVQTATSIIPGATPADASRYIGLPIFANLLGYVVGTLVLSPLADRVGRRRMLMTTMFITGVGSLLTALAMRDWWFILARGITGVGVAADLAVVNTYMSEVAPRRARAKYTSGLFIFSGVGALVGIWLGLWLTTPSAPFPEGLPFALATSSFHWGWRLMYYIGAVLALIALLLRIELPESPRWLAAKGRVEEAAAVVAAMEERLGLGAFQSDGTAASFSLVSDTRAPYGELFGSPVYRRRIFLLFFVWLFSYVTVYGFSAGMTTLLVGAGYAPSEAGLIVAVGVLGMLLAGVVAYLAGEVMERKTYLLVSAVLTILGGLVVGLAGHHLWLSYLGAILLFFGQNVWVPVFYAWTAENFPSRARTSGFALVDGAGHIGAGVGLWAIAPLIPSLGVTAGFVAMSGFLLIAAFIALGGIASRGKVLEEISP

SEQ ID NO: 777 - protein, 476 aa, Artificial
  Substituion in SEQ ID NO 766
MGTGVPVSSAAGILARMERLTAWPLPRRLFLVIGLGYLFTFYDIFDINVSFVQTATSIIPGATPADASRYIGLPIFANLLGYVVGTLVLSPLADRVGRRRMLMTTMFITGVGSLLTALAMRDWWFILARGITGVGVAADLAVVNTYMSEVAPRRARAKYTSGLFIFSGVGALVGIWLGLWLTTPSAPFPEGLPFALATSSFHWGWRLMYYIGAVLALIALLLRLELPESPRWLAAKGRVEEAAAVVAAMEERLGLGAFQSDGTAASFSLVSDTRAPYGELFGSPVYRRRIFLLFFVWLFSYVTVYGFSAGMTTLLVGAGYAPSEAGLIVAVGVLGMLLAGVVAYLAGEVMERKTYLLVSAVLTILGGLVVGLAGHHLWLSYLGAILLFFGQNVWVPVFYAWTAENFPSRARTSGFALVDGAGHIGAGVGLWAIAPLIPSLGVTAGFVAMSGFLLIAAFIALGGIASRGKVLEEISP

SEQ ID NO: 778 - DNA, 1431 bp, Artificial
  Substituion in SEQ ID NO 767
atgggcacgggtgtgcctgtttcgagcgcggcgggcatcttggcgcggatggagcggttgaccgcatggccgcttccgcggcgattgttcctcgtcatcggtctcgggtatctgttcaccttctacgacatattcgacgtcaatgtgtcctttgtgcagaccgccacatccatcatacccggtgcaactccggcggacgccagccggtacatcggattgcccatcttcgccaacctgttggggtacgtgattggcacgcttgtgttgagccctcttgccgatcgcgtcgggcgaaggcgtatgctgatgaccaccatgttcatcacgggggtcggttctctgttgacagctctcgcgatgcgcgactggtggtttattctcgcgcgcggcatcacgggcgtgggcgtggccgcggatctggctgtcgtgaatacctacatgagcgaggtcgcgccgagaagagcgagggcgaagtacacctcaggattgttcattttctcaggtgtcggagcgcttgtgggcatctggctcgggttgtggttgacgacgcccagtgcgccgtttccggaaggacttccgtttgcgcttgcaacttcgtcgttccattggggctggcggttgatgtactacatcggggcggtactcgcgctcatcgcactcctgctgcggcttgagctccctgagtctcctcgctggctggccgcgaaggggcgagtcgaagaagccgccgctgttgtagctgctatggaggagcgcctgggcttgggcgcgtttcaatccgatggaaccgccgcatcgttctcgctggtctccgacacgcgcgcgccgtatggcgaactgtttggcagtcctgtgtatcgcaggcgaatcttcctcctgtttttcgtctggctctttagctatgtgaccgtgtacggattttctgcaggcatgaccacgctgctcgtgggcgcaggctatgcgccgagtgaggcggggctcatcgtggccgtcggcgtcttgggcatgctgctggccggcgtcgtggcgtaccttgcgggagaagtcatggaacgcaaaacctatctgctcgtgtctgcggtcctgaccatcttgggaggactcgtggtggggcttgctggacaccatctgtggctttcgtacctcggtgcaatcctcctcttcttcgggcagaacgtgtgggtgccggtgttttacgcgtggactgcggaaaactttccatctcgcgcgaggaccagcggtttcgccctcgtggatggagcgggacacatcggcgccggagtcggtttgtgggccatcgcgccgttgattccctctctcggcgtgaccgccggatttgtggcgatgtcgggcttccttctgatcgcggcgttcatcgcccttggagggattgcgtctcgaggcaaagttttggaggagatttcgccgtag

SEQ ID NO: 779 - DNA, 1431 bp, Artificial
  Substituion in SEQ ID NO 767
atgggcacgggtgtgcctgtttcgagcgcggcgggcatcttggcgcggatggagcggttgaccgcatggccgcttccgcggcgattgttcctcgtcatcggtctcgggtatctgttcaccttctacgacatattcgacgtcaatgtgtcctttgtgcagaccgccacatccatcatacccggtgcaactccggcggacgccagccggtacatcggattgcccatcttcgccaacctgttggggtacgtggtcggcacgcttgtgttgagccctcttgccgatcgcgtcgggcgaaggcgtatgctgatgaccaccatgttcatcacgggggtcggttctctgttgacagctctcgcgatgcgcgactggtggtttattctcgcgcgcggcatcacgggcgtgggcgtggccgcggatctggctgtcgtgaatacctacatgagcgaggtcgcgccgagaagagcgagggcgaagtacacctcaggattgttcattttctcaggtgtcggagcgcttgtgggcatctggctcgggttgtggttgacgacgcccagtgcgccgtttccggaaggacttccgtttgcgcttgcaacttcgtcgttccattggggctggcggttgatgtactacatcggggcggtactcgcgctcatcgcactcctgctgcggcttgagctccctgagtctcctcgctggctggccgcgaaggggcgagtcgaagaagccgccgctgttgtagctgctatggaggagcgcctgggcttgggcgcgtttcaatccgatggaaccgccgcatcgttctcgctggtctccgacacgcgcgcgccgtatggcgaactgtttggcagtcctgtgtatcgcaggcgaatcttcctcctgtttttcgtctggctctttagctatgtgaccgtgtacggattttctgcaggcatgaccacgctgctcgtgggcgcaggctatgcgccgagtgaggcggggctcatcattgccgtcggcgtcttgggcatgctgctggccggcgtcgtggcgtaccttgcgggagaagtcatggaacgcaaaacctatctgctcgtgtctgcggtcctgaccatcttgggaggactcgtggtggggcttgctggacaccatctgtggctttcgtacctcggtgcaatcctcctcttcttcgggcagaacgtgtgggtgccggtgttttacgcgtggactgcggaaaactttccatctcgcgcgaggaccagcggtttcgccctcgtggatggagcgggacacatcggcgccggagtcggtttgtgggccatcgcgccgttgattccctctctcggcgtgaccgccggatttgtggcgatgtcgggcttccttctgatcgcggcgttcatcgcccttggagggattgcgtctcgaggcaaagttttggaggagatttcgccgtag

SEQ ID NO: 780 - DNA, 1431 bp, Artificial
  Substituion in SEQ ID NO 767
atgggcacgggtgtgcctgtttcgagcgcggcgggcatcttggcgcggatggagcggttgaccgcatggccgcttccgcggcgattgttcctcgtcatcggtctcgggtatctgttcaccttctacgacatattcgacgtcaatgtgtcctttgtgcagaccgccacatccatcatacccggtgcaactccggcggacgccagccggtacatcggattgcccatcttcgccaacctgttggggtacgtggtcggcacgcttgtgttgagccctcttgccgatcgcgtcgggcgaaggcgtatgctgatgaccaccatgttcatcacgggggtcggttctctgttgacagctctcgcgatgcgcgactggtggtttattctcgcgcgcggcatcacgggcgtgggcgtggccgcggatctggctgtcgtgaatacctacatgagcgaggtcgcgccgagaagagcgagggcgaagtacacctcaggattgttcattttctcaggtgtcggagcgcttgtgggcatctggctcgggttgtggttgacgacgcccagtgcgccgtttccggaaggacttccgtttgcgcttgcaacttcgtcgttccattggggctggcggttgatgtactacatcggggcggtactcgcgctcatcgcactcctgctgcggcttgagctccctgagtctcctcgctggctggccgcgaaggggcgagtcgaagaagccgccgctgttgtagctgctatggaggagcgcctgggcttgggcgcgtttcaatccgatggaaccgccgcatcgttctcgctggtctccgacacgaaagcgccgtatggcgaactgtttggcagtcctgtgtatcgcaggcgaatcttcctcctgtttttcgtctggctctttagctatgtgaccgtgtacggattttctgcaggcatgaccacgctgctcgtgggcgcaggctatgcgccgagtgaggcggggctcatcgtggccgtcggcgtcttgggcatgctgctggccggcgtcgtggcgtaccttgcgggagaagtcatggaacgcaaaacctatctgctcgtgtctgcggtcctgaccatcttgggaggactcgtggtggggcttgctggacaccatctgtggctttcgtacctcggtgcaatcctcctcttcttcgggcagaacgtgtgggtgccggtgttttacgcgtggactgcggaaaactttccatctcgcgcgaggaccagcggtttcgccctcgtggatggagcgggacacatcggcgccggagtcggtttgtgggccatcgcgccgttgattccctctctcggcgtgaccgccggatttgtggcgatgtcgggcttccttctgatcgcggcgttcatcgcccttggagggattgcgtctcgaggcaaagttttggaggagatttcgccgtag

SEQ ID NO: 781 - DNA, 1431 bp, Artificial
  Substituion in SEQ ID NO 767
atgggcacgggtgtgcctgtttcgagcgcggcgggcatcttggcgcggatggagcggttgaccgcatggccgcttccgcggcgattgttcctcgtcatcggtctcgggtatctgttcaccttctacgacatattcgacgtcaatgtgtcctttgtgcagaccgccacatccatcatacccggtgcaactccggcggacgccagccggtacatcggattgcccatcttcgccaacctgttggggtacgtggtcggcacgcttgtgttgagccctcttgccgatcgcgtcgggcgaaggcgtatgctgatgaccaccatgttcatcacgggggtcggttctctgttgacagctctcgcgatgcgcgactggtggtttattctcgcgcgcggcatcacgggcgtgggcgtggccgcggatctggctgtcgtgaatacctacatgagcgaggtcgcgccgagaagagcgagggcgaagtacacctcaggattgttcattttctcaggtgtcggagcgcttgtgggcatctggctcgggttgtggttgacgacgcccagtgcgccgtttccggaaggacttccgtttgcgcttgcaacttcgtcgttccattggggctggcggttgatgtactacatcggggcggtactcgcgctcatcgcactcctgctgcggattgagctccctgagtctcctcgctggctggccgcgaaggggcgagtcgaagaagccgccgctgttgtagctgctatggaggagcgcctgggcttgggcgcgtttcaatccgatggaaccgccgcatcgttctcgctggtctccgacacgcgcgcgccgtatggcgaactgtttggcagtcctgtgtatcgcaggcgaatcttcctcctgtttttcgtctggctctttagctatgtgaccgtgtacggattttctgcaggcatgaccacgctgctcgtgggcgcaggctatgcgccgagtgaggcggggctcatcgtggccgtcggcgtcttgggcatgctgctggccggcgtcgtggcgtaccttgcgggagaagtcatggaacgcaaaacctatctgctcgtgtctgcggtcctgaccatcttgggaggactcgtggtggggcttgctggacaccatctgtggctttcgtacctcggtgcaatcctcctcttcttcgggcagaacgtgtgggtgccggtgttttacgcgtggactgcggaaaactttccatctcgcgcgaggaccagcggtttcgccctcgtggatggagcgggacacatcggcgccggagtcggtttgtgggccatcgcgccgttgattccctctctcggcgtgaccgccggatttgtggcgatgtcgggcttccttctgatcgcggcgttcatcgcccttggagggattgcgtctcgaggcaaagttttggaggagatttcgccgtag

SEQ ID NO: 782 - DNA, 1431 bp, Artificial
  Substituion in SEQ ID NO 767
atgggcacgggtgtgcctgtttcgagcgcggcgggcatcttggcgcggatggagcggttgaccgcatggccgcttccgcggcgattgttcctcgtcatcggtctcgggtatctgttcaccttctacgacatattcgacattaatgtgtcctttgtgcagaccgccacatccatcatacccggtgcaactccggcggacgccagccggtacatcggattgcccatcttcgccaacctgttggggtacgtggtcggcacgcttgtgttgagccctcttgccgatcgcgtcgggcgaaggcgtatgctgatgaccaccatgttcatcacgggggtcggttctctgttgacagctctcgcgatgcgcgactggtggtttattctcgcgcgcggcatcacgggcgtgggcgtggccgcggatctggctgtcgtgaatacctacatgagcgaggtcgcgccgagaagagcgagggcgaagtacacctcaggattgttcattttctcaggtgtcggagcgcttgtgggcatctggctcgggttgtggttgacgacgcccagtgcgccgtttccggaaggacttccgtttgcgcttgcaacttcgtcgttccattggggctggcggttgatgtactacatcggggcggtactcgcgctcatcgcactcctgctgcggcttgagctccctgagtctcctcgctggctggccgcgaaggggcgagtcgaagaagccgccgctgttgtagctgctatggaggagcgcctgggcttgggcgcgtttcaatccgatggaaccgccgcatcgttctcgctggtctccgacacgcgcgcgccgtatggcgaactgtttggcagtcctgtgtatcgcaggcgaatcttcctcctgtttttcgtctggctctttagctatgtgaccgtgtacggattttctgcaggcatgaccacgctgctcgtgggcgcaggctatgcgccgagtgaggcggggctcatcgtggccgtcggcgtcttgggcatgctgctggccggcgtcgtggcgtaccttgcgggagaagtcatggaacgcaaaacctatctgctcgtgtctgcggtcctgaccatcttgggaggactcgtggtggggcttgctggacaccatctgtggctttcgtacctcggtgcaatcctcctcttcttcgggcagaacgtgtgggtgccggtgttttacgcgtggactgcggaaaactttccatctcgcgcgaggaccagcggtttcgccctcgtggatggagcgggacacatcggcgccggagtcggtttgtgggccatcgcgccgttgattccctctctcggcgtgaccgccggatttgtggcgatgtcgggcttccttctgatcgcggcgttcatcgcccttggagggattgcgtctcgaggcaaagttttggaggagatttcgccgtag

What is claimed is:

1. An isolated or purified nucleic acid comprising a nucleic acid encoding a polypeptide having at least 90% sequence identity to SEQ ID NO: 562 wherein said polypeptide has ABC chitooligosaccharide transport activity.

2. The isolated or purified nucleic acid of claim 1, wherein the polypeptide has activity at about pH 8.

3. The isolated or purified nucleic acid of claim 1, wherein the polypeptide has activity at about 35 degrees Celsius.

4. The isolated or purified nucleic acid of claim 1, wherein the nucleic acid is present in a vector.

5. A method of transporting a sugar across a cell membrane, the method comprising:
   providing to a cell the isolated or purified nucleic acid of claim 1;
   incorporating into or associating with the cell membrane of the cell the protein encoded by the nucleic acid; and
   transporting a sugar across said membrane utilizing the protein encoded by the nucleic acid.

6. The method according to claim 5, wherein transporting a sugar across said membrane utilizing the protein encoded by the nucleic acid occurs at about pH 8.

7. The method according to claim 5, wherein transporting a sugar across said membrane utilizing the protein encoded by the nucleic acid occurs at about 35 degrees Celsius.

8. The isolated or purified nucleic acid of claim 1, wherein the encoded polypeptide has activity below pH 8.

9. The isolated or purified nucleic acid of claim 1, wherein the encoded polypeptide has activity at a temperature above 35 degrees Celsius.

10. The method according to claim 5, wherein transporting a sugar across said membrane utilizing the protein encoded by the nucleic acid occurs below pH 8.

11. The method according to claim 5, wherein transporting a sugar across said membrane utilizing the protein encoded by the nucleic acid occurs at a temperature above 35 degrees Celsius.

12. The isolated or purified nucleic acid according to claim 1, wherein said nucleic acid is at set forth in SEQ ID NO:563.

* * * * *

UNITED STATES PATENT AND TRADEMARK OFFICE
CERTIFICATE OF CORRECTION

| | |
|---|---|
| PATENT NO. | : 7,960,534 B2 |
| APPLICATION NO. | : 12/380554 |
| DATED | : June 14, 2011 |
| INVENTOR(S) | : David N. Thompson et al. |

It is certified that error appears in the above-identified patent and that said Letters Patent is hereby corrected as shown below:

On the title page:
In ITEM (56) References Cited
OTHER PUBLICATIONS

Page 1, 2nd column, 1st line of the
1st entry (line 9),          change "495497." to --495-497.--

Page 1, 2nd column, 2nd line of the
13th entry (line 33),          change "27," to --12,--

Page 1, 2nd column, 1st line of the
21st entry (line 55),          change "Neddleman" to --Needleman--

Page 2, 2nd column, 1st line of the
27th entry (line 42),          change "Functiona" to --Function--

Page 2, 2nd column, 2nd line of the
29th entry (line 49),          change "Quarlty" to --Quarterly--

In the specification:
COLUMN 29, LINE 26,          change "495497." to --495-497.--

Signed and Sealed this
First Day of October, 2013

Teresa Stanek Rea
*Deputy Director of the United States Patent and Trademark Office*